US008014957B2

(12) United States Patent
Radich et al.

(10) Patent No.: US 8,014,957 B2
(45) Date of Patent: Sep. 6, 2011

(54) GENES ASSOCIATED WITH PROGRESSION AND RESPONSE IN CHRONIC MYELOID LEUKEMIA AND USES THEREOF

(75) Inventors: Jerald P. Radich, Sammamish, WA (US); Hongyue Dai, Kenmore, WA (US); Mao Mao, Kirkland, WA (US); Janell M. Schelter, Bellevue, WA (US); Peter S. Linsley, Seattle, WA (US)

(73) Assignees: Fred Hutchinson Cancer Research Center, Seattle, WA (US); Rosetta Inpharmatics LLC, Seattle, WA (US)

( * ) Notice: Subject to any disclaimer, the term of this patent is extended or adjusted under 35 U.S.C. 154(b) by 593 days.

(21) Appl. No.: 11/640,517

(22) Filed: Dec. 14, 2006

(65) Prior Publication Data

US 2007/0154931 A1    Jul. 5, 2007

Related U.S. Application Data

(60) Provisional application No. 60/751,455, filed on Dec. 15, 2005.

(51) Int. Cl.
*G01N 33/48* (2006.01)

(52) U.S. Cl. ............ 702/19; 702/32; 702/189; 703/2; 706/18; 435/6; 435/7.1; 436/63; 436/64

(58) Field of Classification Search ............... None
See application file for complete search history.

(56) References Cited

U.S. PATENT DOCUMENTS

| | | | |
|---|---|---|---|
| 4,215,051 A | 7/1980 | Schroeder et al. |
| 5,272,071 A | 12/1993 | Chappel |
| 5,510,270 A | 4/1996 | Fodor et al. |
| 5,514,548 A | 5/1996 | Krebber et al. |
| 5,539,083 A | 7/1996 | Cook et al. |
| 5,545,522 A | 8/1996 | Van Gelder et al. |
| 5,556,752 A | 9/1996 | Lockhart et al. |
| 5,578,832 A | 11/1996 | Trulson et al. |
| 5,716,785 A | 2/1998 | Van Gelder et al. |
| 5,891,636 A | 4/1999 | Van Gelder et al. |
| 5,985,615 A | 11/1999 | Jakobovits et al. |
| 6,004,941 A | 12/1999 | Bujard et al. |
| 6,028,189 A | 2/2000 | Blanchard |
| 6,057,098 A | 5/2000 | Buechler et al. |
| 6,218,122 B1 | 4/2001 | Friend et al. |
| 6,271,002 B1 | 8/2001 | Linsley et al. |
| 7,171,311 B2 | 1/2007 | Dai et al. |
| 2003/0104426 A1 | 6/2003 | Linsley et al. |
| 2003/0224374 A1 | 12/2003 | Dai et al. |
| 2005/0048542 A1 | 3/2005 | Baker et al. |
| 2006/0292623 A1* | 12/2006 | Linsley et al. ............ 435/6 |

FOREIGN PATENT DOCUMENTS

| | | |
|---|---|---|
| WO | WO 88/04300 | 12/1987 |
| WO | WO 88/10315 | 12/1988 |
| WO | WO 89/06700 | 7/1989 |
| WO | WO 91/06667 | 5/1991 |
| WO | WO 91/17271 | 11/1991 |
| WO | WO 92/01047 | 1/1992 |
| WO | WO 92/15679 | 9/1992 |
| WO | WO 92/18619 | 10/1992 |
| WO | WO 92/20791 | 11/1992 |
| WO | WO 92/22635 | 12/1992 |
| WO | WO 93/01288 | 1/1993 |
| WO | WO 99/15650 | 4/1999 |
| WO | WO 01/05935 A2 | 1/2001 |
| WO | WO 02/070494 A1 | 9/2002 |
| WO | WO 2005/018534 A2 | 3/2005 |

OTHER PUBLICATIONS

Valenzuela et al., "Angiopoietins 3 and 4: Diverging gene counterparts in mice and humans", 1999, Proceedings of the National Academy of Science USA, vol. 96, pp. 1904-1909.*
Merriam-Webster online dictionary, "patient" definition, 2010, on the world wide web at http://www.merriam-webster.com/dictionary/patient, 2 pages.*
Abdi, 1994, "A Neural Network Primer", Journal of Biological Systems 2(3):247-281.
Alizadeh et al., 2000, "Distinct types of diffuse large B-cell lymphoma identified by gene expression profiling," Nature 403: 503-511.
Ben Dor et al., 2000, "Tissue classification with gene expression profiles", J Comput Biol 7(Mar. 4):559-583.
Blanchard et al., 1996, "High-density oligonucleotide arrays", Biosensors & Bioelectronics 11(Jun. 7):687-690.
Blanchard, 1998, "Synthetic DNA Arrays", *Genetic Engineering* New York pp. 111-123.
Boesen et al., 1993, "Circumvention of chemotherapy-induced myelosuppression by transfer of the mdrl gene", Biotherapy 6(4):291-302.
Bonaldo et al., 1996, "Normalization and subtraction: two approaches to facilitate gene discovery", Genome Res 6(9):791-806.
Branford et al., 2003, "Detection of BCR-ABL mutations in patients with CML treated with imatinib is virtually always accompanied by clinical resistance, and mutations in the ATP phosphate-binding loop (P-loop) are associated with a poor prognosis", Blood 102(1):276-283.
Brown et al., 2000, "Knowledge-based analysis of microarray gene expression data by using support vector machines", Proc Natl Acad Sci U S A 97(1):262-267.
Brummelkamp et al., 2002, "A system for stable expression of short interfering RNAs in mammalian cells", Science 296(5567):550-553.
Calabretta and Perrotti, 2004, "The biology of CML blast crisis", Blood 103(11):4010-4022.

(Continued)

*Primary Examiner* — Carolyn L. Smith
(74) *Attorney, Agent, or Firm* — Woodcock Washburn LLP

(57) ABSTRACT

The invention provides molecular markers that are associated with the progression of chronic myeloid leukemia (CML), and methods and computer systems for monitoring the progression of CML in a patient based on measurements of these molecular markers. The present invention also provides CML target genes, and methods and compositions for treating CML patients by modulating the expression or activity of these CML target genes and/or their encoded proteins. The invention also provides genes that are associated with resistance to imatinib mesylate (Gleevec™) treatment in CML patients, and methods and compositions for determining the responsiveness of a CML patient to imatinib mesylate treatment based on measurements of these genes and/or their encoded proteins. The invention also provides methods and compositions for enhancing the effect of Gleevec™ by modulating the expression or activity of these genes and/or their encoded proteins.

16 Claims, 13 Drawing Sheets

OTHER PUBLICATIONS

Figure 1:
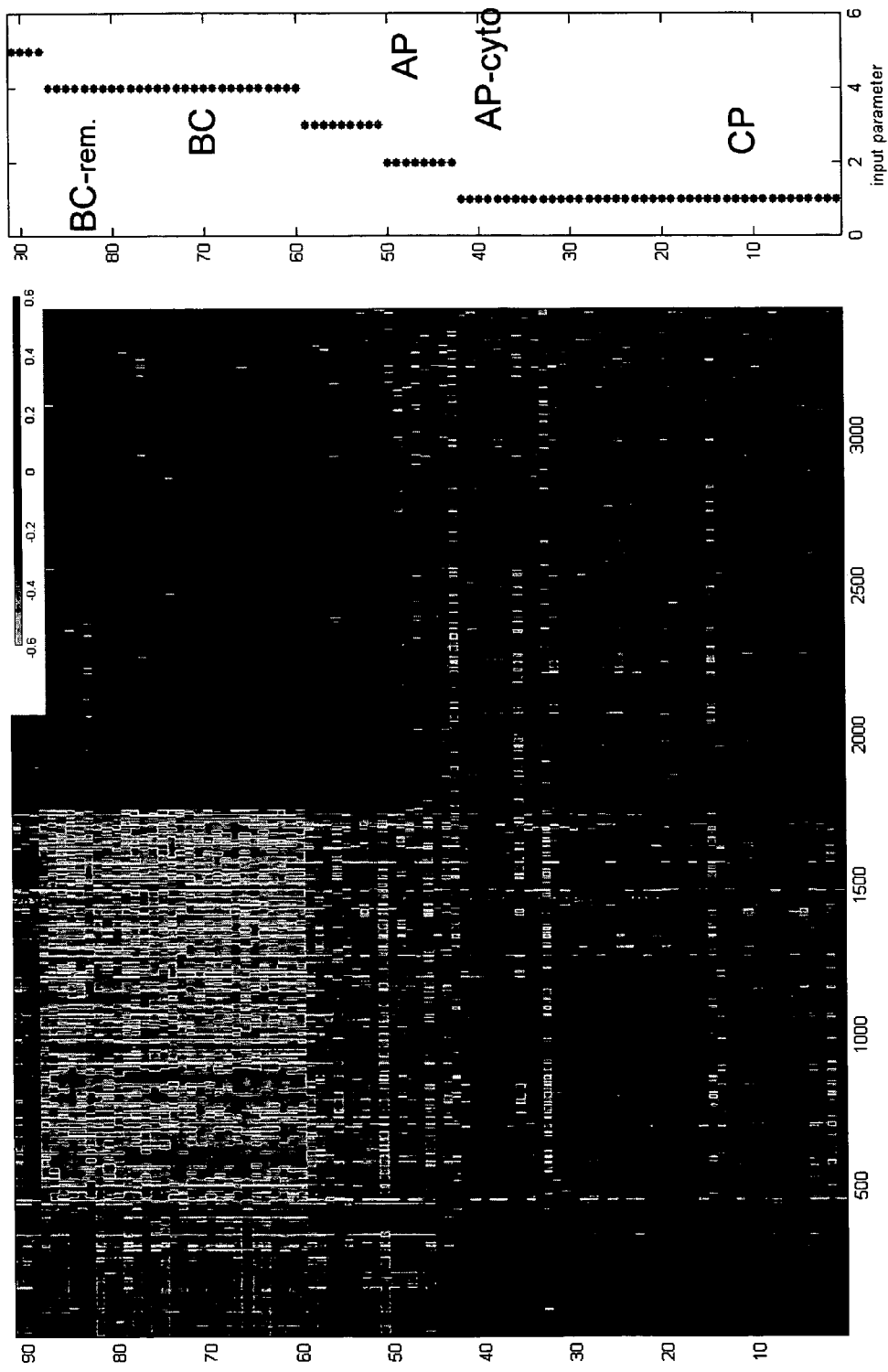

Carulli et al., 1998, "High throughput analysis of differential gene expression", J Cell Biochem Suppl. 30-31:286-296.

Clowes et al., 1994, "Long-term biological response of injured rat carotid artery seeded with smooth muscle cells expressing retrovirally introduced human genes", J Clin Invest 93(2):644-651.

Cohen, 1993, "Naked DNA points way to vaccines", Science 259(5102):1691-1692.

DeRisi et al., 1996, "Use of a cDNA microarray to analyse gene expression patterns in human cancer", Nat Genet 14(4):457-460.

Druker et al., 2001, "Efficacy and safety of a specific inhibitor of the BCR-ABL tyrosine kinase in chronic myeloid leukemia", N Engl J Med 344(14):1031-1037.

Egholm et al., 1993, "PNA hybridizes to complementary oligonucleotides obeying the Watson-Crick hydrogen-bonding rules", Nature 365(6446):566-568.

Elbashir et al., 2002, "Analysis of gene function in somatic mammalian cells using small interfering RNAs", Methods 26(2):199-213.

Ewing and Green, 2000, "Analysis of expressed sequence tags indicates 35,000 human genes", Nat Genet 25(2):232-234.

Faderl et al., 1999, "The biology of chronic myeloid leukemia", N Engl J Med 341(3):164-172.

Faderl et al., 1999, "Chronic myelogenous leukemia: biology and therapy", Ann Intern Med 131(3):207-219.

Ferguson et al., 1996, "A fiber-optic DNA biosensor microarray for the analysis of gene expression", Nat Biotechnol 14(13):1681-1684.

Fishwild et al., 1996, "High-avidity human IgG kappa monoclonal antibodies from a novel strain of minilocus transgenic mice", Nat Biotechnol 14(7):845-851.

Fodor et al., 1991, "Light-directed, spatially addressable parallel chemical synthesis", Science 251(4995):767-773.

Froehler et al., 1986, "Synthesis of DNA via deoxynucleoside H-phosphonate intermediates", Nucleic Acids Res 14(13):5399-5407.

Furey et al., 2000, "Support vector machine classification and validation of cancer tissue samples using microarray expression data", Bioinformatics 16(10):906-914.

Gaboli et al., 2001, "Mzf1 controls cell proliferation and tumorigenesis", Genes Dev 15(13):1625-1630.

Hughes et al., 2001, "Expression profiling using microarrays fabricated by an ink-jet oligonucleotide synthesizer", Nat Biotechnol 19(4):342-347.

Huse et al., 1989, "Generation of a large combinatorial library of the immunoglobulin repertoire in phage lambda", Science 246(4935):1275-1281.

Inouye and Inouye, 1985, "Up-promoter mutations in the lpp gene of *Escherichia coli*", Nucleic Acids Res 13(9):3101-31 10.

Jamieson et al., 2004, "Granulocyte-macrophage progenitors as candidate leukemic stem cells in blast-crisis CML", N Engl J Med 351(7):657-667.

Kantarjian et al., 1999, "Treatment of Philadelphia chromosome-positive early chronic phase chronic myelogenous leukemia with daily doses of interferon alpha and low-dose cytarabine", J Clin Oncol 17(1):284-292.

Kononen et al., 1998, "Tissue microarrays for high-throughput molecular profiling of tumor specimens", Nat Med 4(7):844-847.

Kusano et al., 2002, "I-mfa domain proteins interact with Axin and affect its regulation of the Wnt and c-Jun N-terminal kinase signaling pathways", Mol Cell Biol 22(18):6393-6405.

Lam et al., 1991, "A new type of synthetic peptide library for identifying ligand-binding activity", Nature 354(6348):82-84.

Lander, 1996, "The new genomics: global views of biology", Science 274(5287):536-539.

Li and Cohen, 1996, "Tsg101: a novel tumor susceptibility gene isolated by controlled homozygous functional knockout of allelic loci in mammalian cells", Cell 85(3):319-329.

Lockhart et al., 1996, "Expression monitoring by hybridization to high-density oligonucleotide arrays", Nat Biotechnol 14(13):1675-1680.

Maskos and Southern, 1992, "Oligonucleotide hybridizations on glass supports: a novel linker for oligonucleotide synthesis and hybridization properties of oligonucleotides synthesised in situ", Nucleic Acids Res 20(7):1679-1684.

Matsushita et al., 2001, "Quantitative monitoring of the PRAME gene for the detection of minimal residual disease in leukaemia", Br J Haematol 112(4):916-926.

McElwaine et al., 2004, "Microarray transcript profiling distinguishes the transient from the acute type of megakaryoblastic leukaemia (M7) in Down's syndrome, revealing PRAME as a specific discriminating marker", Br J Haematol 125(6):729-742.

Mori et al., 1997, "Absence of microsatellite instability during the progression of chronic myelocytic leukemia", Leukemia 11(1):151-152.

Park et al., 2001, "A nonparametric scoring algorithm for identifying informative genes from microarray data", Pac Symp Biocomput :52-63.

Passegue et al., 2004, "JunB deficiency leads to a myeloproliferative disorder arising from hematopoietic stem cells", Cell 119(3):431-443.

Platt et al., 1994, "Independent regulation of adipose tissue-specificity and obesity response of the adipsin promoter in transgenic mice", J Biol Chem 269(46):28558-28562.

Radich et al., 2004, "Individual-specific variation of gene expression in peripheral blood leukocytes", Genomics 83(6):980-988.

Radich et al., 2003, "HLA-matched related hematopoietic cell transplantation for chronic-phase CML using a targeted busulfan and cyclophosphamide preparative regimen", Blood 102(1):31-35.

Ren, 2002, "The molecular mechanism of chronic myelogenous leukemia and its therapeutic implications: studies in a murine model", Oncogene 21(56):8629-8642.

Robertson and Wolfe, 2000, "DNA methylation in health and disease", Nat Rev Genet 1(1):11-19.

Schena et al., 1995, "Quantitative monitoring of gene expression patterns with a complementary DNA microarray", Science 270(5235):467-470.

Schena et al., 1996, "Parallel human genome analysis: microarray-based expression monitoring of 1000 genes", Proc Natl Acad Sci U S A 93(20):10614-10619.

Shah et al., 2002, "Multiple BCR-ABL kinase domain mutations confer polyclonal resistance to the tyrosine kinase inhibitor imatinib (STI571) in chronic phase and blast crisis chronic myeloid leukemia", Cancer Cell 2(2):1 17-125.

Shalon et al., 1996, "A DNA microarray system for analyzing complex DNA samples using two-color fluorescent probe hybridization", Genome Res 6(7):639-645.

Shet et al., 2002, "Chronic myelogenous leukemia: mechanisms underlying disease progression", Leukemia 16(8):1402-1411.

Sokal et al., 1984, "Prognostic discrimination in 'good-risk' chronic granulocytic leukemia", Blood 63(4):789-799.

van't Veer et al., 2002, "Gene expression profiling predicts clinical outcome of breast cancer," Nature 415(6871): 530-536.

Velculescu et al., 1995, "Serial analysis of gene expression", Science 270 (5235):484-487.

Wada et al., 1994, "Genomic instability of microsatellite repeats and its association with the evolution of chronic myelogenous leukemia", Blood 83(12):3449-3456.

Zien et al., 2000, "Engineering support vector machine kernels that recognize translation initiation sites", Bioinformatics 16(9):799-807.

\* cited by examiner

GENES ASSOCIATED WITH PROGRESSION AND RESPONSE IN CHRONIC MYELOID LEUKEMIA AND USES THEREOF

This application claims the benefit, under 35 U.S.C. §19 (e), of U.S. Provisional Patent Application No. 60/751,455, filed on Dec. 15, 2005, which is incorporated herein by reference in its entirety.

This invention was made with U.S. Government support under Contract Nos. CA-18029 and CA-85053 awarded by the National Institutes of Health of the United States Department of Health and Human Services. The U.S. Government has certain rights in the invention.

This application includes a Sequence Listing submitted on compact disc, recorded on two compact discs, including one duplicate, containing Filename seqlisting 9301-253-999 as filed.txt, of size 10,385,215 bytes, created Dec. 8, 2006. The Sequence Listing on the compact discs is incorporated by reference herein in its entirety.

1. FIELD OF THE INVENTION

The invention relates to molecular markers that are associated with the progression of chronic myeloid leukemia (CML). The invention also relates to methods and computer systems tor evaluating the progression of CML based on these molecular markers. The present invention also relates to methods and compositions for treating CML patients by modulating the expression or activity of certain genes involved in CML progression and/or their encoded proteins. The invention further relates to methods and compositions for determining the responsiveness of a CML patient to imatinib mesylate (Gleevec™).

2. BACKGROUND OF THE INVENTION

Chronic myeloid leukemia (CML) is a hematopoetic stem cell disease with distinct biological and clinical features. In humans, a majority of CML (about 95%) has been found to be associated with a chromosomal abnormality that involves a t(9;22)(q34;q11) translocation, which results in the expression of the BCR/ABL fusion gene (Philadelphia Chromosome or Ph). The rest is associated with either a cryptic translocation that is invisible on G-banded chromosome preparations or a variant translocation involving another chromosome or chromosomes as well as chromosomes 9 and 22. CML usually presents in the so-called chronic phase, in which the clonal expansion of mature myeloid cells leads to an elevated white blood cell (WBC) count. Without curative intervention chronic phase CML will invariably transform through a phase of "acceleration," often heralded by the appearance of increased immature myeloid cells in the bone marrow and peripheral blood, as well as new cytogenetic changes in addition to the Ph chromosome. Progression then proceeds quickly to blast crisis, with immature blast cells overwhelming the production of normal hematopoetic elements. Blast crisis is highly resistant to treatment, with death generally occurring from infection and bleeding complications secondary to the absence of normal granulocytes and platelets. The median time from diagnosis of chronic phase CML to progression blast crisis is approximately 3-4 years but the range of timing is quite broad, encompassing from 0.5-15 years (Faderl et al., 1999, Ann Intern Med 131:207).

There is a broad range of treatment options for CML. All treatments work far better on chronic phase disease than on accelerated or blast phase. The only known curative therapy for CML is stem cell transplantation, a complex and potentially toxic modality that carries a high potential for morbidity and mortality (Radich et al., 2003, Blood 102:31). Non-transplant therapy includes alpha interferon, which can produce a major reduction in the proportion of Ph positive cells and extend the natural history of the disease in approximately 10-20% of cases (Kantarjian et al., 1999, J Clin Oncol 17:284). The tyrosine kinase inhibitor, imatinib mesylate, suppresses the Ph to the point where it is undetectable by cytogenetic evaluation ("complete cytogenetic remission") in >70% of newly diagnosed chronic phase CML cases (Druker et al., 2001, N Engl J Med 344:1031). The duration of such responses is unknown, as is potential for cure with imatinib. Resistance to imatinib occurs (especially in advanced phase disease) often accompanied by point mutations in the active area of imatinib binding in the abl gene (Shah et al., 2002, Cancer Cell 2:117). The natural history of such relapses is unknown, though some appear to have a speedy entry into advanced disease (Branford et al., 2003, Blood 102:276).

U.S. Patent Application Publication No. 2003/0104426 A1 discloses genetic markers whose expression correlates with progression of CML. Specifically, the patent application discloses sets of markers whose expression patterns can be used to differentiate chronic phase individuals from those in blast crisis, and methods of using these markers to distinguish these conditions. The patent application also discloses kits containing ready-to-use microarrays and computer data analysis software for carrying out the disclosed methods.

PRAME (Preferentially Expressed Antigen of Melanoma) was identified as a tumor antigen recognized by cytotoxic T-cells against a melanoma surface antigen (Matsushita et al., 2001, Br J Haematol 112:916, 2001; van Baren et al., 1998, Br J Haematol 102:1376). PRAME has been found to be overexpressed in over 25% of leukemia, and has been found to be induced by Bcr-Abl in CML cell lines (Watari et al., 2000, FEBS Lett 466:367). PRAME over-expression has been described as one of the few features that characterize the transient myeloproliferative syndrome of Down's syndrome from the progressive acute megakaryoblastic leukemia found in that disorder (McElwaine et al., 2004, Br J Haematol 125: 729).

The genetic events that cause the progression of chronic phase to blast crisis CML are unknown (Calabretta et al., 2004, Blood 103:4010; Shet et al., 2002, Leukemia 16:1402). Numerous genetic abnormalities have been demonstrated, including chromosomal changes including a multiplication of the Ph, the disruption of TP53, the deletion of the p15/p16 tumor suppressor genes (the latter only in lymphoid blast crisis). However, none of these changes are particularly common. Genetic instability is apparent in the additional chromosomal changes that occur with progression, though standard assays of instability, such as alterations in minisatellite repeats, is relatively uncommon (Wada et al., 1994, Blood 83:3449; Mori et al., 1997, Leukemia 11:151). Unfortunately, clinical and molecular tests cannot predict where on the "clock" of progression an individual lies at the time of the initial diagnosis, and this makes it impossible to tailor therapy to the degree of risk that faces an individual CML patient. It is also not possible to identify the subset of patients who will benefit most from the variety of therapy options, such as interferon, imatinib, or transplantation. Thus, presently tailoring therapy to individual risk is difficult. There is therefore a need to identify genes whose levels of expression change during the evolution of the chronic phase to blast crisis. There is a need for methods that utilize measured expression levels of such genes to determine the phase and/or progression of CML in a patient. There is also a need for methods of treating CML by targeting such genes.

3. SUMMARY OF THE INVENTION

The invention provides a method for determining the progression of chronic myeloid leukemia (CML) in a patient, comprising (a) classifying a marker profile comprising measurements of a plurality of gene products in a cell sample taken from said patient as a chronic phase (CP-CML) profile or as an advanced phase (ADV-CML) profile, wherein said gene products are respectively products of at least 5 of the genes listed in Table 1a and/or Table 1b or respective functional equivalents thereof, wherein at least one of said 5 genes is from Table 1a; and (b) determining said patient as in a chronic phase if said marker profile is classified as a CP-CML profile, or determining said patient as in an advanced phase if said marker profile is classified as an ADV-CML profile. In one embodiment, said plurality of gene products are of at least 5, 10, 20, 50, 70 or 100 of the genes listed in Table 1a. In one embodiment, said cell sample is a bone marrow sample or a peripheral blood sample.

In one embodiment, the method further comprises obtaining said marker profile by a method comprising measuring said plurality of gene products in a cell sample taken from said patient.

In preferred embodiments, said gene products are products of at least 10, at least 20, at least 40, at least 70, at least 100, or at least 500 of the genes, respectively, listed in Table 1a and/or 1b.

In another preferred embodiment, said gene products are products of at least 10, at least 20, at least 40, at least 70, at least 100, or at least 200 of the genes, respectively, listed in Table 2a.

In still another preferred embodiment, said gene products are products of at least 5, 6, 7, 8, 9, 10, 11, 12, 13, 14, 15, 16, 17, 18, 19 or all of the genes, respectively, corresponding to the markers listed in Table 3. In one embodiment, said gene products are products of at least 5, 6, 7, 8, 9 or all of the genes, respectively, corresponding to the up-regulated markers listed in Table 3, or are products of at least 5, 6, 7, 8, 9 or all of the genes, respectively, corresponding to the down-regulated markers listed in Table 3.

In one embodiment, each of said gene products is a gene transcript.

In one embodiment, measurement of each said gene transcript is obtained by a method comprising contacting a positionally-addressable microarray with nucleic acids from said cell sample or nucleic acids derived therefrom under hybridization conditions, and detecting the amount of hybridization that occurs, said microarray comprising one or more polynucleotide probes complementary to a hybridizable sequence of each said gene transcript.

In another embodiment, measurement of each said gene transcript is obtained by quantitative reverse transcriptase PCR (qRT-PCR).

In another embodiment, each of said plurality of gene products is a protein.

In a preferred embodiment, said classifying is carried out using a progression classifier, which receives an input comprising said marker profile and provides an output comprising data indicating whether said marker profile is a CP-CML profile or an ADV-CML profile.

In one embodiment, said progression classifier is trained with training data from a plurality of training CML patients, wherein said training data comprise for each of said plurality of training CML patients (i) a training maker profile comprising measurements of said plurality of gene products in a cell sample taken from said training patient; and (ii) data indicating whether said training patient is in CP-CML or ADV-CML.

In a preferred embodiment, said progression classifier comprises a CP-CML template comprising measurements of said plurality of gene products representative of measurements of said plurality of genes products in a plurality of patients having CP-CML and/or an ADV-CML template comprising measurements of said plurality of gene products representative of measurements of said plurality of genes products in a plurality of patients having ADV-CML, and said step of classifying is carried out by a method comprising (i) comparing said marker profile with said CP-CML template and/or said ADV-CML template; and (ii) classifying said marker profile as a CP-CML profile if said marker profile has a high similarity to said CP-CML template and/or has a low similarity to said ADV-CML template, or classifying said marker profile as a ADV-CML profile if said marker profile has a high similarity to said ADV-CML template and/or has a low similarity to said CP-CML template, wherein a high similarity corresponds to a degree of similarity above a predetermined threshold, and wherein a low similarity corresponds to a degree of similarity no greater than said predetermined threshold.

In a specific embodiment, said step of classifying is carried out by a method comprising (i) comparing said marker profile with said CP-CML template or said ADV-CML template; and (ii) classifying said marker profile as a CP-CML profile if said marker profile has a high similarity to said CP-CML template or has a low similarity to said ADV-CML template, or classifying said marker profile as a ADV-CML profile if said marker profile has a high similarity to said ADV-CML template or has a low similarity to said CP-CML template, wherein a high similarity corresponds to a degree of similarity above a predetermined threshold, and wherein a low similarity corresponds to a degree of similarity no greater than said predetermined threshold.

In another specific embodiment, said step of classifying is carried out by a method comprising (i) comparing said marker profile with said CP-CML template and said ADV-CML template; and (ii) classifying said marker profile as a CP-CML profile if said marker profile has a higher similarity to said CP-CML template than to said ADV-CML template, or classifying said marker profile as a ADV-CML profile if said marker profile has a higher similarity to said ADV-CML template than to said CP-CML template.

In one embodiment, said similarity to said CP-CML template is represented by a correlation coefficient between said marker profile and said CP-CML template, wherein said similarity to said ADV-CML template is represented by a correlation coefficient between said marker profile and said ADV-CML template. In one embodiment, said correlation coefficients between said marker profile and said CP-CML template and said ADV-CML template are respectively calculated according to the equation $$P_i = (\vec{z}_i \cdot \vec{y}) / (\|\vec{z}_i\| \cdot \|\vec{y}\|)$$

where i=1 and 2, wherein $\vec{y}$ represents said marker profile, $\vec{z}_1$ represents said CP-CML template, and $\vec{z}_2$ represents said ADV-CML template, $P_1$ represents said correlation coefficient between said marker profile and said CP-CML template, and $P_2$ represents said correlation coefficient between said marker profile and said ADV-CML template.

In one embodiment, the measurement of each gene product in said CP-CML template or said ADV-CML template is an average of the measurements of said gene product in a plurality of CP-CML patients or in a plurality of ADV-CML patients, respectively.

In one embodiment, said measurement of each gene product in said marker profile is a relative level of said gene product in said cell sample taken from the patient versus level of said gene product in a reference pool, represented as a log ratio; the respective measurement of each gene product in said CP-CML template is a relative level of said gene product representative of level of said gene product in a plurality of CP-CML patients versus level of said gene product in a reference pool, represented as a log ratio; and the respective measurement of each gene product in said ADV-CML template is a relative level of said gene product representative of level of said gene product in a plurality of ADV-CML patients versus level of said gene product in a reference pool, represented as a log ratio.

In one embodiment, the respective log ratio for each gene product in said CP-CML template or said ADV-CML template is an average of the log ratios for said gene product in a plurality of CP-CML patients or in a plurality of ADV-CML patients, respectively.

In another preferred embodiment, said progression classifier is an artificial neural network (ANN) or a support vector machine (SVM).

The invention also provides a method for assigning a therapeutic regimen for a CML patient, comprising (a) determining the progression of said patient using any of the above described methods; and (b) assigning said patient a therapeutic regimen according to the status of progression determined in step (a). In one embodiment, said patient is determined to be in ADV-CML, and said therapeutic regimen assigned to said patient comprises bone marrow transplant.

The invention also provides a method for enrolling CML patients for a clinical trial of an agent for treating CML, comprising (a) determining the progression of said patient using any of the above described methods; and (b) assigning each patient having a CP-CML to one patient group and each patient having an ADV-CML to another patient group, at least one of said patient group being enrolled in said clinical trial.

The invention also provides a method for determining the responsiveness of a chronic myeloid leukemia (CML) patient to imatinib mesylate (IM), comprising (a) determining the progression of said patient using any of the above described methods; and (b) determining said patient as responsive to IM treatment if said marker profile is classified as a CP-CML profile, or determining said patient as resistant to IM treatment if said marker profile is classified as an ADV-CML profile.

In another aspect, the invention provides a method for determining the responsiveness of a chronic myeloid leukemia (CML) patient to imatinib mesylate (IM), comprising (a) classifying a marker profile comprising measurements of a plurality of gene products in a cell sample taken from said patient as an IM-sensitive profile or an IM-resistant profile, wherein said gene products are respectively products of at least 5 of the genes listed in Table 4 or respective functional equivalents thereof, and (b) determining said patient as responsive to IM treatment if said marker profile is classified as an IM-sensitive profile, or determining said patient as resistant to IM treatment if said marker profile is classified as an IM-resistant profile. In one embodiment, said plurality of gene products are of at least 5 of the genes listed in Table 4. In one embodiment, said cell sample is a bone marrow sample or a peripheral blood sample.

In one embodiment, the method further comprises obtaining said marker profile by a method comprising measuring said plurality of gene products in a cell sample taken from said patient.

In preferred embodiments, said gene products are products of at least 10, at least 20, at least 40, at least 70, at least 100, or at least 200 of the genes, respectively, listed in Table 4.

In one embodiment, each of said gene products is a gene transcript.

In one embodiment, measurement of each said gene transcript is obtained by a method comprising contacting a positionally-addressable microarray with nucleic acids from said cell sample or nucleic acids derived therefrom under hybridization conditions, and detecting the amount of hybridization that occurs, said microarray comprising one or more polynucleotide probes complementary to a hybridizable sequence of each said gene transcript.

In another embodiment, each of said plurality of gene products is a protein.

In a preferred embodiment, said classifying is carried out by a method comprising using a progression classifier, wherein said progression classifier receives an input comprising said marker profile and provides an output comprising data indicating whether said marker profile is an IM-sensitive profile or an IM-resistant profile.

In one embodiment, said progression classifier is trained with training data from a plurality of training CML patients, wherein said training data comprise for each of said plurality of training CML patients (i) a training maker profile comprising measurements of said plurality of gene products in a cell sample taken from said training patient; and (ii) data indicating whether said training patient is sensitive or resistant to imatinib mesylate.

In one embodiment, said progression classifier comprises an IM-sensitive template comprising measurements of said plurality of gene products representative of measurements of said plurality of genes products in a plurality of patients responsive to IM treatment and/or an IM-resistant template comprising measurements of said plurality of gene products representative of measurements of said plurality of genes products in a plurality of patients resistant to IM treatment, and said step of classifying is carried out by a method comprising (a1) comparing said marker profile with said IM-sensitive template and/or said IM-resistant template; and (a2) classifying said marker profile as a IM-sensitive profile if said marker profile has a high similarity to said IM-sensitive template and/or has a low similarity to said IM-resistant template, or classifying said marker profile as a IM-resistant profile if said marker profile has a high similarity to said IM-resistant template and/or has a low similarity to said IM-sensitive template, wherein a high similarity corresponds to a degree of similarity above a predetermined threshold, and wherein a low similarity corresponds to a degree of similarity no greater than said predetermined threshold.

In a specific embodiment, said step of classifying is carried out by a method comprising (a1) comparing said marker profile with said IM-sensitive template or said IM-resistant template; and (a2) classifying said marker profile as an IM-sensitive profile if said marker profile has a high similarity to said IM-sensitive template or has a low similarity to said IM-resistant template, or classifying said marker profile as a IM-resistant profile if said marker profile has a high similarity to said IM-resistant template or has a low similarity to said IM-sensitive template, wherein a high similarity corresponds to a degree of similarity above a predetermined threshold, and wherein a low similarity corresponds to a degree of similarity no greater than said predetermined threshold.

In another specific embodiment, said step of classifying is carried out by a method comprising (a1) comparing said marker profile with said IM-sensitive template and said IM-resistant template; and (a2) classifying said marker profile as an IM-sensitive profile if said marker profile has a higher similarity to said IM-sensitive template than to said IM-resistant template, or classifying said marker profile as a IM-resistant profile if said marker profile has a higher similarity to said IM-resistant template than to said IM-sensitive template.

In one embodiment, said similarity to said IM-sensitive template is represented by a correlation coefficient between said marker profile and said IM-sensitive template, and said similarity to said IM-resistant template is represented by a correlation coefficient between said marker profile and said IM-resistant template.

In one embodiment, said correlation coefficients between said marker profile and said IM-sensitive template and said IM-sensitive template are respectively calculated according to the equation $$P_i = (\vec{z}_i \cdot \vec{y}) / (\|\vec{z}_i\| \cdot \|\vec{y}\|)$$

where i=1 and 2, wherein $\vec{y}$ represents said marker profile, $\vec{z}_1$ represents said IM-sensitive template, and $\vec{z}_2$ represents said IM-resistant template, $P_1$ represents said correlation coefficient between said marker profile and said IM-sensitive template, and $P_2$ represents said correlation coefficient between said marker profile and said IM-resistant template.

In one embodiment, the measurement of each gene product in said IM-sensitive template or said IM-resistant template is an average of the measurements of said gene product in a plurality of patients responsive to IM treatment or in a plurality of patients resistant to IM treatment, respectively.

In one embodiment, said measurement of each gene product in said marker profile is a relative level of said gene product in said cell sample taken from the patient versus level of said gene product in a reference pool, represented as a log ratio; the respective measurement of each gene product in said IM-sensitive template is a relative level of said gene product representative of level of said gene product in a plurality of patients responsive to IM treatment versus level of said gene product in a reference pool, represented as a log ratio; and the respective measurement of each gene product in said IM-resistant template is a relative level of said gene product representative of level of said gene product in a plurality of patients resistant to IM treatment versus level of said gene product in a reference pool, represented as a log ratio.

In one embodiment, the respective log ratio for each gene product in said IM-sensitive template or said IM-resistant template is an average of the log ratios for said gene product in a plurality of patients responsive to IM treatment or in a plurality of ADV-CML patients, respectively.

In another preferred embodiment, said progression classifier is an artificial neural network (ANN) or a support vector machine (SVM).

The invention also provides a method for assigning a treatment regimen for a CML patient, comprising (i) determining whether said patient is responsive or resistant to imatinib mesylate using a method as described above; and (ii) assigning said patient a treatment regimen comprising bone marrow transplant if said patient is determined to be resistant to imatinib mesylate.

The invention also provides a method for enrolling CML patients for a clinical trial of a treatment modality for treating CML, comprising (i) determining whether said patient is responsive or resistant to imatinib mesylate using a method as described above; and (ii) assigning each patient who is predicted to be resistant to imatinib mesylate to one patient group and each patient who is predicted to be responsive to imatinib mesylate to another patient group, at least one of said patient group being enrolled in said clinical trial.

In still another aspect, the invention provides a method for treating a patient having chronic myeloid leukemia (CML), comprising administering to said patient a treatment regimen, said treatment regimen comprising one or more agents that modulate the expression and/or activity of one or more different genes listed in one or more of Tables 2a, 2b, 5a and 5b and/or their encoded proteins, wherein said patient exhibits aberrant regulation of said one or more genes.

In one embodiment, said one or more different genes are selected from the different genes listed in one or more of Tables 2a and 5a.

In another embodiment, said one or more different genes are selected from the genes listed in both Tables 2a and 5a, i.e., genes common in Tables 2a and 5a.

In still another embodiment, said one or more different genes are selected from the genes listed in Table 3.

In one embodiment, said one or more different genes are selected from the up-regulated genes listed in Table 3, and said treatment regimen comprises a substance selected from the group consisting of siRNA, antisense nucleic acid, ribozyme, and triple helix forming nucleic acid, each reducing the expression of one or more of said one or more different genes in said patient.

In another embodiment, said one or more different genes are selected from the up-regulated genes listed in Table 3, and said treatment regimen comprises a substance selected from the group consisting of antibody, peptide, and small molecule, each reducing the activity of one or more of proteins encoded by said one or more different genes in said patient.

In a preferred embodiment, said treatment regimen comprises an siRNA targeting said one or more different genes.

In preferred embodiment, said one or more different genes consisting of 2, 3, 4, 5, 6, or 10 different genes.

In another embodiment, said one or more different genes are selected from the down-regulated genes listed in Table 3, and said treatment regimen comprises subjecting said patient to gene therapy, said gene therapy enhancing the expression of said one or more different genes in said patient.

In one embodiment, the methods of the invention further comprises determining a transcript level of each of said one or more different genes, and said patient is determined to exhibit aberrant regulation of said different gene if said transcript level deviated from a predetermined threshold level. In some embodiments, said transcript level deviates from said predetermined threshold level by at least 1.5-fold, 2-fold or 3-fold.

In one embodiment, each said transcript level is determined by a method comprising measuring the transcript level of said different gene using one or more polynucleotide probes, each of said one or more polynucleotide probes comprising a nucleotide sequence complementary to a hybridizable sequence in said transcript of said different gene. In one embodiment, said one or more polynucleotide probes are polynucleotide probes on a microarray.

In another embodiment, each said transcript level is determined by a method comprising measuring the transcript level of said different gene using quantitative reverse transcriptase PCT (qRT-PCR).

In still another aspect, the invention provides a method for treating a patient having chronic myeloid leukemia (CML), comprising administering to said patient a treatment regimen, said treatment regimen comprising (i) an effective amount of imatinib mesylate (IM), and (ii) an agent other than IM, wherein said agent modulates the expression and/or activity of 1, 2, 3, 4, 5, 10 or more of the genes listed in Table 4 and/or their encoded proteins, and wherein said patient exhibits aberrant regulation of said one or more genes.

In one embodiment, said one or more genes are selected from the group consisting of the up-regulated genes listed in Table 4, and said agent comprises a substance selected from the group consisting of siRNA, antisense nucleic acid, ribozyme, and triple helix forming nucleic acid, each reducing the expression of one or more of said one or more genes in said patient.

In another embodiment, said one or more genes are selected from the group consisting of the up-regulated genes listed in Table 4, and said agent comprises a substance selected from the group consisting of antibody, peptide, and small molecule, each reducing the activity of one or more of proteins encoded by said one or more genes in said patient.

In one embodiment, said treatment regimen comprises an siRNA targeting said one or more target genes.

In some embodiments, said one or more genes consists of at least 2, 3, 4, 5, 6, or 10 target genes.

In one embodiment, said one or more genes are selected from the group consisting of the down-regulated genes listed in Table 4, and said agent comprises subject said patient to gene therapy, said gene therapy enhancing the expression of said one or more genes in said patient.

The methods can further comprises determining a transcript level of each said gene, and said patient is determined to exhibit aberrant regulation of said gene if said transcript level deviated from a predetermined threshold level. In some embodiment, said transcript level deviates from said predetermined threshold level by at least 1.5-fold, 2-fold or 3-fold.

In one embodiment, each said transcript level is determined by a method comprising measuring the transcript level of said gene using one or more polynucleotide probes, each of said one or more polynucleotide probes comprising a nucleotide sequence complementary to a hybridizable sequence in said transcript of said different gene.

In one embodiment, said one or more polynucleotide probes are polynucleotide probes on a microarray.

In another embodiment, each said transcript level is determined by a method comprising measuring the transcript level of said CML target gene using quantitative reverse transcriptase PCT (qRT-PCR).

In still another aspect, the invention provides a method for diagnosing whether a patient has advanced phase chronic myeloid leukemia (CML), comprising (a) contacting cells a cell sample from said patient with an antibody conjugate, said antibody conjugate comprising an antibody that binds a PRAME protein, said antibody being conjugated with a label; and (b) detecting said label on said cells, wherein detection of said label above a predetermined threshold indicates that said patient has advanced phase CML. The cell sample can be a bone marrow sample or a peripheral blood sample.

In one embodiment, said antibody is a monoclonal antibody.

In another embodiment, said label is fluorescence label, and said detecting is carried out using a fluorescence activated cell sorter.

In still another aspect, the invention provides a method for treating a patient having chronic myeloid leukemia (CML), comprising administering to said patient a therapeutically sufficient amount of an antibody, wherein said antibody binds a PRAME protein, and wherein said patient expresses PRAME protein on hematopoetic stem cells and/or immature myeloid cells. The invention also provides a method for treating a patient having chronic myeloid leukemia (CML), comprising administering to said patient a therapeutically sufficient amount of an antibody conjugate comprising an antibody that binds a PRAME protein, said antibody being conjugated with a therapeutic molecule, wherein said patient expresses PRAME protein on hematopoetic stem cells and/or immature myeloid cells.

In one embodiment, said antibody is a monoclonal antibody.

The invention also provides a method for ex vivo depletion of advanced phase hematopoetic stem cells and/or immature myeloid cells from a bone marrow or peripheral blood sample of a patient, comprising (a) incubating said bone marrow or peripheral blood sample with an antibody that binds a PRAME protein; and (b) removing cells having said antibody attached. The invention also provides a method for treating a patient having chronic myeloid leukemia (CML), comprising (i) depleting advanced phase hematopoetic stem cells and/or immature myeloid cells from a bone marrow or peripheral blood sample of said patient using the method described above; and (ii) transplanting the sample obtained in step (i) to said patient.

In still another aspect, the invention provides a method for identifying a set of genes that are associated with progression of chronic myeloid leukemia (CML), comprising: (a) subtracting from each of a plurality of CML expression profiles a CD34+ expression profile to obtain a plurality of CD34+(−) CML expression profiles, each said CML expression profile comprising levels of expression of a plurality of genes in cells of one of a plurality of chronic myeloid leukemia (CML) patients, said CD34+ expression profile comprising levels of expression of said plurality of genes in non cancerous immature CD34+ cells, said plurality of CML patients comprising patients of different phases of CML; (b) comparing said plurality of CD34+(−) CML expression profiles; and (c) identifying one or more genes that exhibit significant differences in levels of expression between different phases of CML across said plurality of CD34+(−) CML expression profiles.

In one embodiment, said comparing is carried out by ANOVA and said identifying is carried out by identifying one or more genes one or more genes whose p-value corresponds to a predetermined significance level. In one embodiment, said predetermined significance level is $p<10^{-8}$.

The method can further comprise: (d) comparing levels of expression of said identified genes between cells of CML blast crisis and normal immature CD34+ cells; and (e) selecting those genes that exhibit significant differences in expression.

In another embodiment, said comparing is carried out by ANOVA and said selecting is carried out by selecting one or more genes whose p-value corresponds to a predetermined significance level. In one embodiment, said predetermined significance level is p-value<0.01%.

The invention also provides a computer system comprising a processor, and a memory coupled to said processor and encoding one or more programs, wherein said one or more programs cause the processor to carry out any one of the methods of the invention.

The invention also provides a computer program product for use in conjunction with a computer having a processor and a memory connected to the processor, said computer program product comprising a computer readable storage medium having a computer program mechanism encoded thereon, wherein said computer program mechanism may be loaded into the memory of said computer and cause said computer to carry out any one of the methods of the invention.

In still anther aspect, the invention provides a microarray comprising for each of a plurality of genes, said genes being at least 5 of the genes selected from the group consisting of the genes as identified respectively by SEQ ID NOS: 1-3968, wherein at least one of said 5 genes is not a gene selected from the group consisting of genes as identified respectively by SEQ ID NOS: 56, 65, 70, 177, 190, 199, 1758, 1773, 1774, 1776, 1786, 1815, 1823, 3925, 3933, 3947, 3956, and 3961, one or more polynucleotide probes complementary and hybridizable to a sequence in said gene, wherein polynucleotide probes complementary and hybridizable to said genes constitute at least 50%, 70%, 80%, 90% or 98% of the probes on said microarray.

In one embodiment, said plurality of genes is at least 10, 20, 40, 70, 100, or 200 genes.

In another embodiment, said plurality of genes is selected from the group consisting of the genes listed in Tables 1a and/or 1b.

In still another embodiment, said plurality of genes is selected from the group consisting of the genes listed in Tables 2a and/or 2b.

In still another embodiment, said plurality of genes is at least 6, 7, 8, 9, 10, 11, 12, 13, 14, 15, 16, 17, 18, 19 or all 20 of the genes listed in Table 3.

In still another embodiment, said plurality of genes are selected from the group consisting of the genes listed in Table 4.

In still another embodiment, said plurality of genes is selected from the group consisting of the genes listed in Tables 5a and/or 5b.

4. BRIEF DESCRIPTION OF THE DRAWINGS

FIG. 1. Genes associated with CML progression. Samples of CML cases in chronic phase, accelerated by cytogenetic criteria only, accelerated phase, blast crisis, and blast crisis "in remission" were compared to a pool of chronic phase RNA. Approximately 3,000 genes were significantly associated with progressive disease at a significance level of $p<10^{-11}$. Each row represents one sample, and each column represents one gene. A darker color indicates over-expression relative to the control pool, and a lighter color indicates low-expression.

FIG. 2. 2a: Genes differentially expressed in blast crisis CML compared to normal CD34+ stem cells. CML blast crisis samples with >70% blasts were compared to normal CD34+ bone marrow stem cells. 2b: Approximately 400 genes were significantly differentially expressed between CML blasts and their immature CD34+ normal counterparts (ANOVA P<0.1%). 2c: Phase genes corrected for normal CD34+ gene expression (ANOVA $P<1\times10^{-8}$). The gene expression of normal CD34+ cells was subtracted from each disease sample. The resulting pattern reflects genes associated with progression independent of normal blast biology.

Figure 3A:
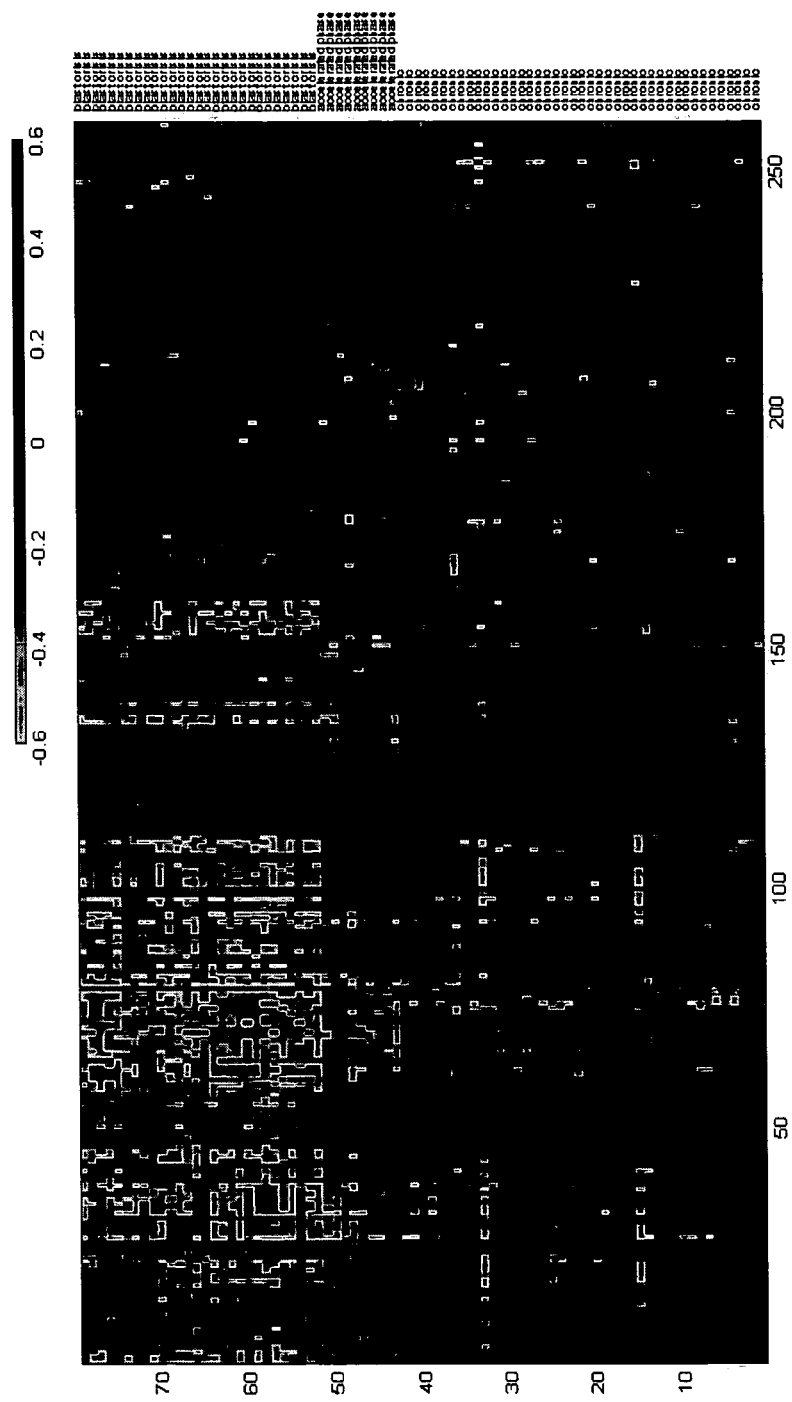
Figure 3B:
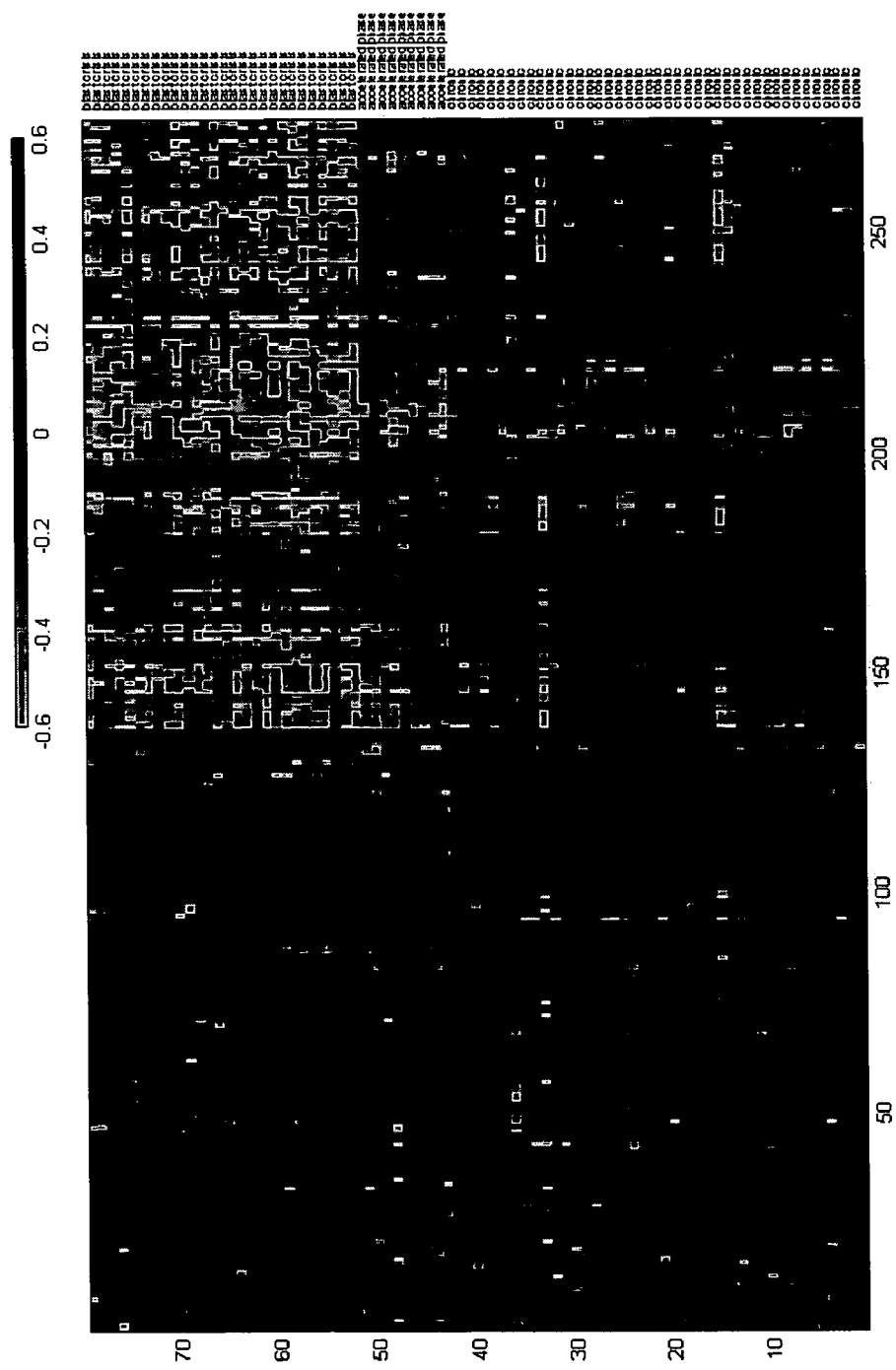

FIG. 3. Genes expression signature of genes associated with specific promoter sequences. Genes with specific promoter sequences were tested for their differential enrichment across different phases of CML (see Methods). FIG. 3a shows genes bearing a MZF promoter; FIG. 3b shows expression of genes under putative control of delta EF1.

FIG. 4. Gene expression in Imatinib failure cases. 4a: All CML cases including cases of imatinib failure; gene expression is based on the previously obtained ~3,000 phase reporter set. 4b: Cases are ranked and sorted by the correlation of summed gene expression, with cases representing the most "cp-like" and most "bc-like" forming the boundaries of gene expression patterns. Cases of imatinib failures are shown. 4c: Genes differentially expressed in imatinib resistant cases that are not associated with progression gene set. The boxed areas represent genes differentially expressed in the imatinib resistant cases compared to blast crisis cases.

Figure 5:
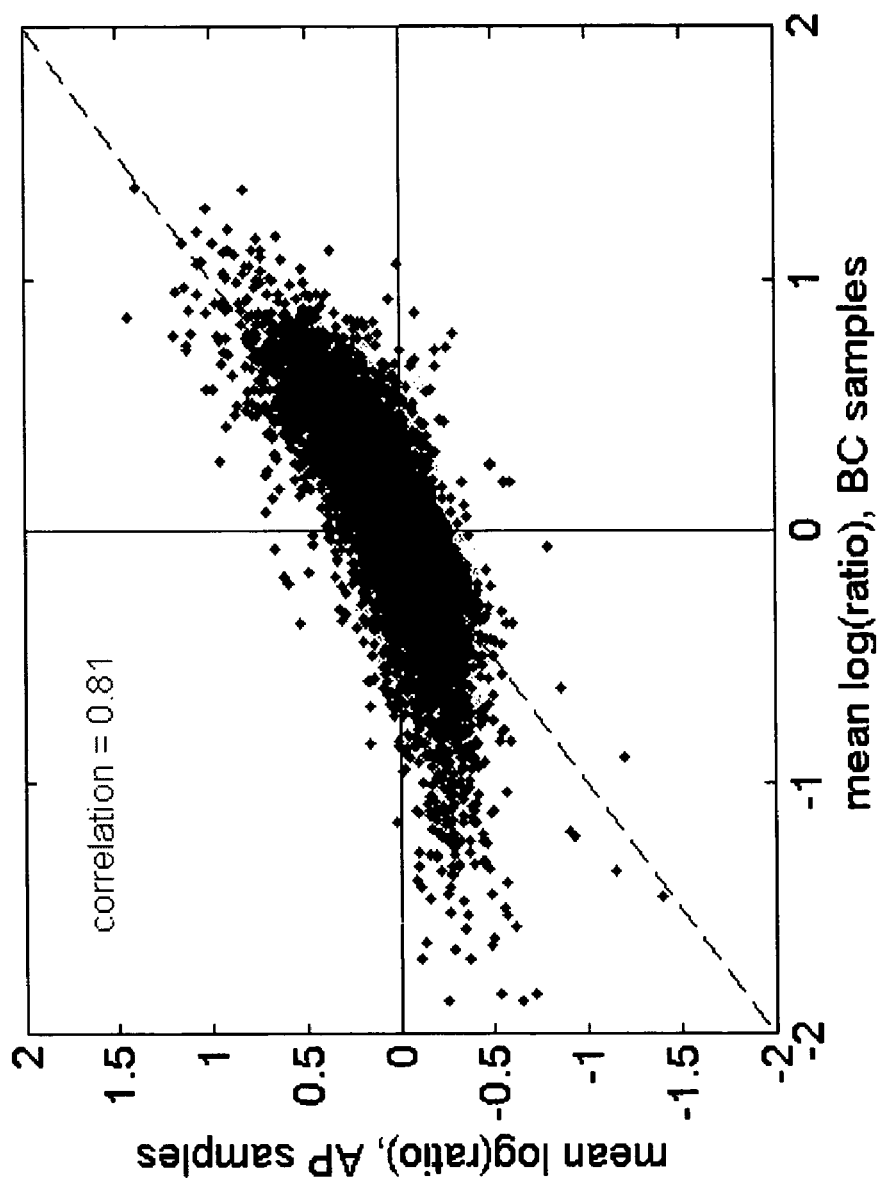

FIG. 5. Comparison of gene expression in accelerated phase versus blast phase CML. The graph shows the scatter plot of log(ratio) of all 25K genes in blast crisis and accelerated phase cases. Each blue dot represents a gene. Thus, genes in the upper left hand box are up in accelerated phase, but down in blast crisis. Genes in the upper right box are up both in accelerated and blast crisis. The gene expression levels are very highly correlated between accelerated and blast crisis (r=0.81).

Figure 6:
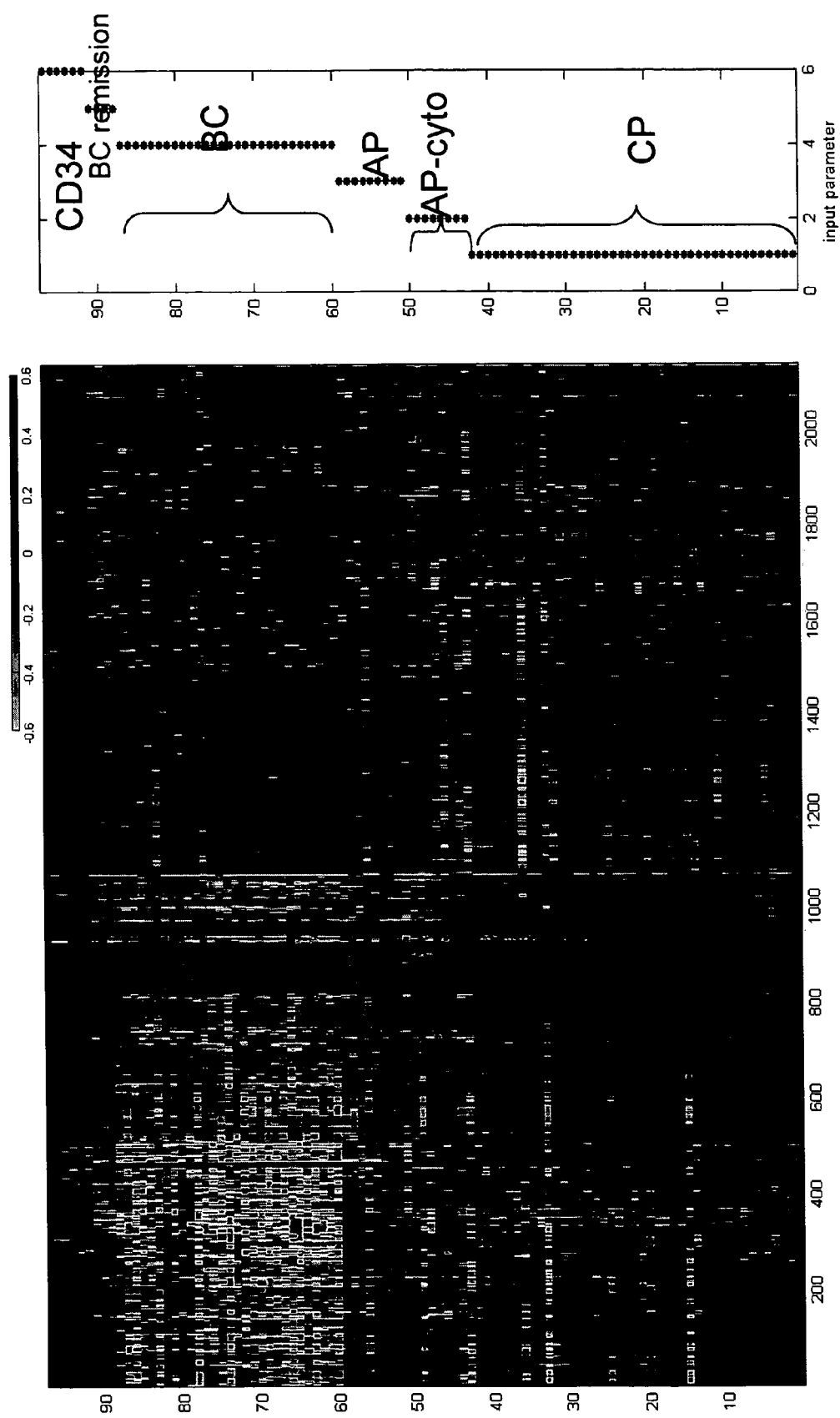

FIG. 6. Phase reporter genes after removal of normal CD34+ signature. The gene expression signature of normal CD34+ cells was subtracted from the data of CML cases. The genes shown are the genes differentially expressed across disease phases after genome wide removal of CD34+ signatures (p-value of $<10^{-4}$).

Figure 7:
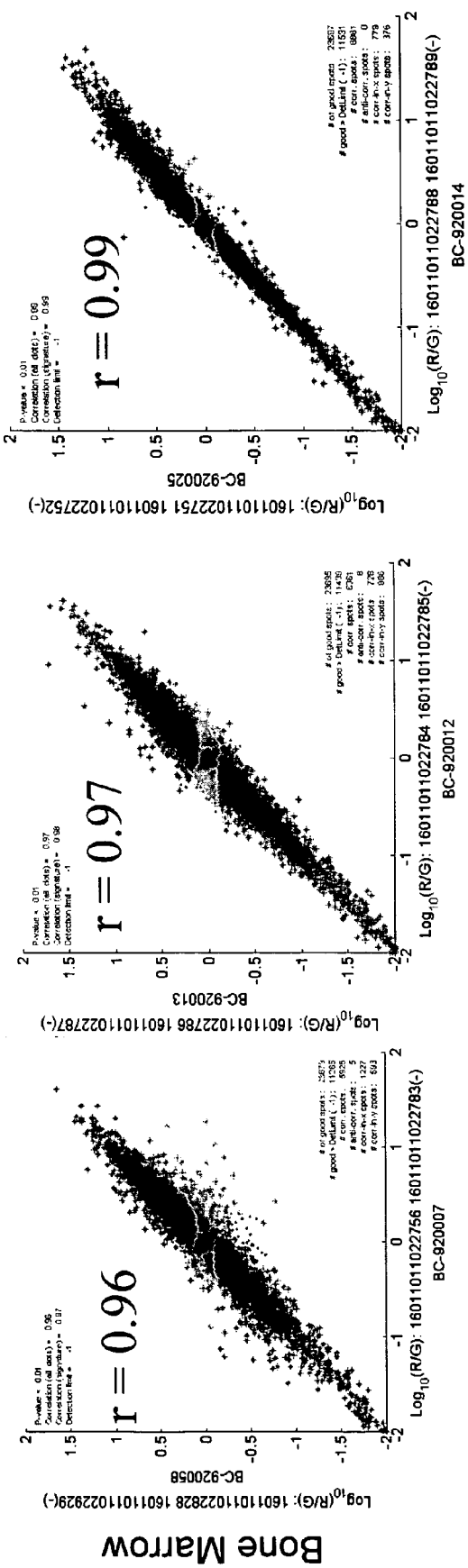

FIG. 7. Comparison of gene expression between bone marrow and peripheral blood. In three cases of blast crisis samples were simultaneously drawn from marrow and blood. The figures show a high correlation of gene expression for these three cases.

Figure 8:
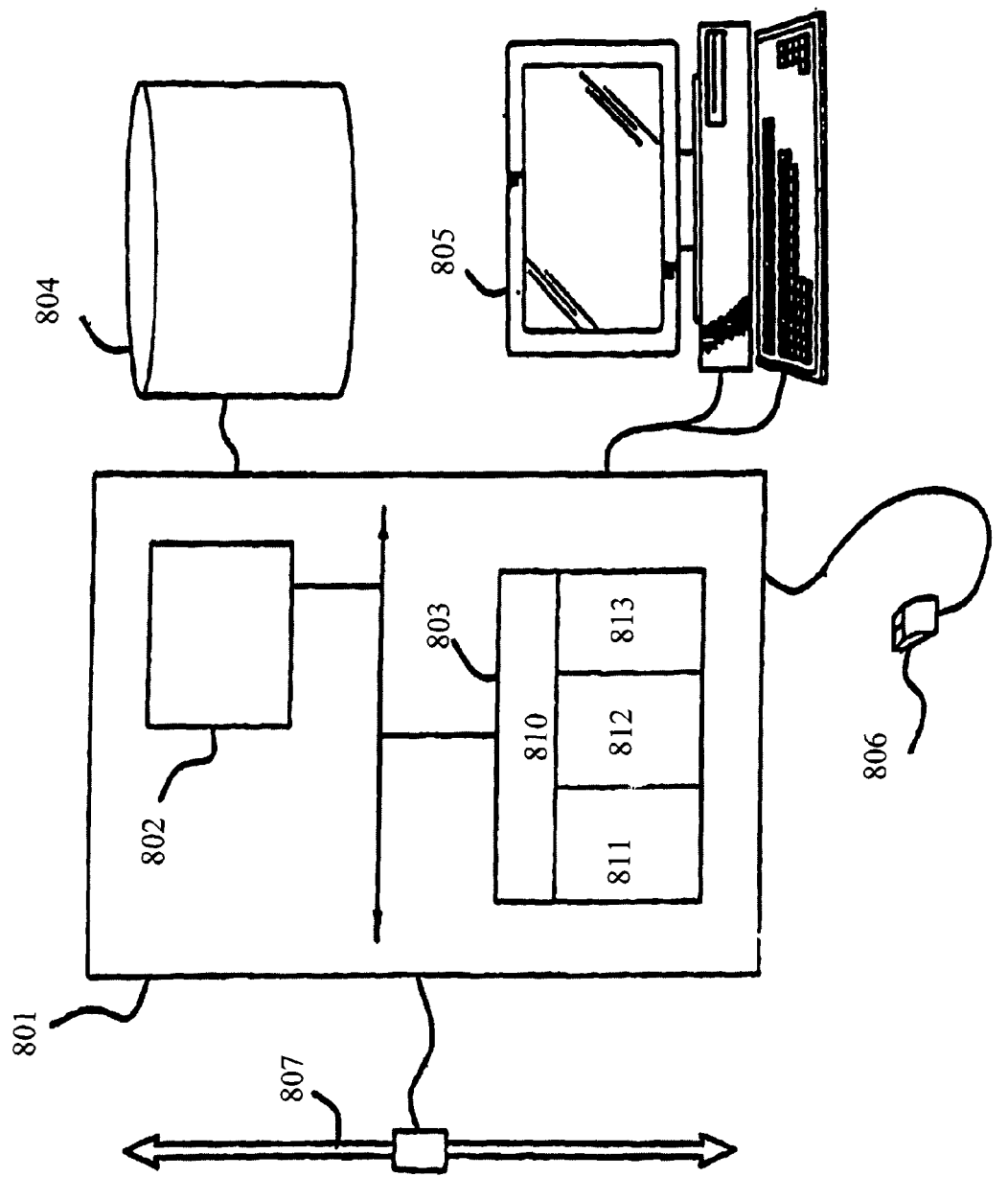

FIG. 8 illustrates an exemplary embodiment of a computer system for implementing the methods of this invention.

5. DETAILED DESCRIPTION OF THE INVENTION

The invention provides molecular markers, i.e., genes, the expression levels of which can be used for evaluating the progression of chronic myeloid leukemia (CML) from chronic phase to advanced phase. The identities of these markers and the measurements of their respective gene products, e.g., measurements of levels (abundances) of their encoded mRNAs or proteins, can be used by application of a pattern recognition algorithm to develop a progression classifier that discriminates between different phases of CML based on measurements of such gene products in a sample from a patient. As used herein, the term "gene product" includes mRNA transcribed from the gene and protein encoded by the gene.

Chronic myelogenous leukemia (CML) is characterized by high peripheral white blood cell (WBC) counts with granulocyte predominance and extramedullary hematopoiesis. CML typically evolves through 3 clinically distinct stages or phases: chronic phase (CP-CML or CP), accelerated phase (AP-CML or AP), and blast phase (BP-CML or BP), which is also called acute phase or blast crisis (BC-CML or BC). The chronic phase lasts several years and is characterized by accumulation of myeloid precursors and mature cells in bone marrow, peripheral blood, and extramedullary sites. During the chronic phase, patients typically have fewer than 10% blasts (or 20% blasts and promyelocytes combined) in blood or bone marrow samples. These patients usually have relatively mild symptoms and usually respond to standard treatments. The chronic phase progresses into the accelerated phase, which lasts about 4 to 6 months. During the accelerated phase, patients typically have more than 10% blasts (or 20% blasts and promyelocytes combined) but less than 30% blasts and promyelocytes in their bone marrow or blood samples. These patients often have fever, poor appetite, and weight loss. Symptoms and blood counts of an AP-CML patient are not as responsive to treatments as they are during the chronic phase. The leukemia cells often have developed new chromosomal changes, in addition to the Philadelphia chromosome.

The accelerated phase progresses to the blast phase, which lasts for a few months. During the blast phase, patients typically have more than 30% blasts and promyelocytes in their bone marrow and/or blood samples. The blast cells often spread to tissues and organs beyond the bone marrow. The accelerated phase and the blast phase are often grouped together into an advanced phase of CML (ADV-CML or ADV). The molecular markers of the invention are particular useful for evaluating the progression of a CML patient from the chronic phase to the advanced phase.

The invention provides a list of genes that are differentially expressed across different phases of CML (Tables 1a and 1b, infra). This set of genes is called the phase reporter geneset. Measurements of gene products of these molecular markers, as well as of their functional equivalents, can be used for staging a CML patient. A functional equivalent with respect to a gene, designated as gene A, refers to a gene that encodes a protein or mRNA that at least partially overlaps in physiological function in the cell to that of the protein or mRNA encoded by gene A. In particular, CML staging in a patient is carried out by a method comprising determining whether the patient is in a chronic phase or an advanced phase (accelerated phase or blast phase) based on a profile of measurements (e.g., of the levels) of gene products of (i.e., encoded by) at least 5, 10, 20, 30, 40, 50, 60, 70, 80, 100, 200, 500 or all of the genes in Tables 1a and/or 1b; or of at least 2%, 5%, 10%, 20%, 30%, 40%, 50%, 60%, 70%, 80%, or 90% of the genes in Tables 1a and/or 1b, or functional equivalents of such genes, in an appropriate cell sample from the patient, e.g., a bone marrow or blood sample obtained from the patient, wherein at least 1, 2, 3, 5, or 10 genes as appropriate are from Table 1a. Such a profile of measurements is also referred to herein as an "expression profile" or a "marker profile." In a specific embodiment, the evaluation of CML progression in a patient is carried out using measurements (e.g., of the levels) of gene products of (i.e., encoded by) at least 5, 10, 20, 30, 40, 50, 60, 70, 80, 100, 200, 500 or all of the genes in Tables 1a; or of at least 2%, 5%, 10%, 20%, 30%, 40%, 50%, 60%, 70%, 80%, or 90% of the genes in Tables 1a, or functional equivalents of such genes. In another specific embodiment, the evaluation of CML progression in a patient is carried out using measurements of gene products of less than 30, 40, 50, 70, 100, 200, 300, 400, or 500 total genes, in which all or at least 20%, 30%, 40%, 50%, 60%, 70%, 80%, or 90% of the genes are from Tables 1a and/or 1b or their functional equivalents, or at least 5, 10, 20, 30, 40, 50, 60, 70, 80, or 100 of the genes are from Tables 1a and/or 1b or their functional equivalents. In one embodiment, if the patient expression profile is classified as a CP-CML profile, the patient is determined as in chronic phase, whereas if the patient expression profile is classified as a ADV-CML profile, the patient is determined as in an advanced phase (accelerated phase or blast crisis).

The invention also provides a list of genes that are associated with CML progression (Tables 2a and 2b, infra). These genes are also termed "progression genes" in the application. This set of genes is called the progression geneset. Measurements of gene products of these molecular markers, as well as of their functional equivalents, can be used for staging a CML patient. Since these genes are associated with CML progression, they are also targets for therapeutic intervention of CML. For example, a CML patient exhibiting aberrant regulation of such genes can be treated by therapies targeting such genes. Thus, measurements of gene products of these molecular markers, as well as of their functional equivalents, can also be used for determining an appropriated treatment regimen for a CML patient.

Different subcombination of CML progression genes can also be used. Thus, in various embodiments, the markers that are the genes listed in Tables 2a-2b or 3 are used. Measurements of gene products of these molecular markers and/or their functional equivalents can be used for evaluating the progression of CML in a patient. The evaluation of CML progression in a patient is carried out by a method comprising determining whether the patient is in a chronic phase or an advanced phase (accelerated phase or blast phase) based on a profile of measurements (e.g., of the levels) of gene products of (i.e., encoded by) at least 5, 10, 20, 30, 40, 50, 60, 70, 80, 100, 200 or all of the genes in Tables 2a and/or 2b, or at least 5, 10, 15 or all of the genes in Table 3; or of at least 2%, 5%, 10%, 20%, 30%, 40%, 50%, 60%, 70%, 80%, or 90% of the genes in Tables 2a and/or 2b or in Table 3, or functional equivalents of such genes, in an appropriate cell sample from the patient, e.g., a bone marrow or peripheral blood sample obtained from the patient, wherein at least 1, 2, 3, 5, or 10 genes as appropriate are from Table 2a. In a specific embodiment, the evaluation of CML progression in a patient is carried out using measurements (e.g., of the levels) of gene products of (i.e., encoded by) at least 5, 10, 20, 30, 40, 50, 60, 70, 80, 100, 200, 300 or all of the genes in Tables 2a; or of at least 2%, 5%, 10%, 20%, 30%, 40%, 50%, 60%, 70%, 80%, or 90% of the genes in Tables 2a, or functional equivalents of such genes. In one embodiment, if the patient expression profile is classified as a CP-CML profile, the patient is determined as in chronic phase, whereas if the patient expression profile is classified as a ADV-CML profile, the patient is determined as in an advanced phase (accelerated phase or blast crisis).

The invention also provides a list of genes that are associated with resistance to imatinib mesylate (Table 4, infra). These genes are also termed "imatinib resistance genes" in the application. This set of genes is called the imatinib resistance geneset. Measurements of gene products of these molecular markers, as well as of their functional equivalents, can be used for evaluating the responsiveness of a CML patient to imatinib treatment. The evaluation of responsiveness of a patient to imatinib is carried out by a method comprising determining whether the patient is likely to be responsive to imatinib treatment based on a profile of measurements (e.g., of the levels) of gene products of (i.e., encoded by) at least 5, 10, 20, 30, 40, 50, 60, 70, 80, 100, 200 or all of the genes in Table 4; or of at least 2%, 5%, 10%, 20%, 30%, 40%, 50%, 60%, 70%, 80%, or 90% of the genes in Table 4, or functional equivalents of such genes, in an appropriate cell sample from the patient, e.g., a bone marrow or peripheral blood sample obtained from the patient. In one embodiment, if the patient expression profile is classified as a IM-resistance profile, the patient is determined as likely to be resistant to imatinib treatment, whereas if the patient expression profile is classified as a IM-sensitive profile, the patient is determined as likely to be responsive to imatinib treatment. In a specific embodiment, a CML patient in the chronic phase is evaluated for responsiveness to imatinib treatment based on an expression profile of such imatinib resistance genes. If the patient's expression profile indicates that the patient is likely to be resistant to imatinib treatment, bone marrow transplantation and/or other investigative treatment regimens may be assigned to the patient.

In another embodiment, the responsiveness of a CML patient to imatinib treatment can also be evaluated based on expression of phase reporters or progression genes. In this embodiment, the patient expression profile comprising measurements of phase reporter genes (Table 1a and/or 1b) or progression genes (Table 2a and/or 2b) is evaluated using a method described above. If the patient expression profile is classified as a ADV-CML profile, the patient is determined as likely to be resistant to imatinib treatment.

The measurements in the profiles of the gene products that are used can be any suitable measured values representative of the expression levels of the respective genes. The measurement of the expression level of a gene can be direct or indirect, e.g., directly of abundance levels of RNAs or proteins or indirectly, by measuring abundance levels of cDNAs, amplified RNAs or DNAs, proteins, or activity levels of RNAs or proteins, or other molecules (e.g., a metabolite) that are indicative of the foregoing. In one embodiment, the profile comprises measurements of abundances of the transcripts of the marker genes. The measurement of abundance can be a measurement of the absolute abundance of a gene product. The measurement of abundance can also be a value representative of the absolute abundance, e.g., a normalized abundance value (e.g., an abundance normalized against the abundance of a reference gene product) or an averaged abundance value (e.g., average of abundances obtained at different time points or from different tumor cell samples from the patients, or average of abundances obtained using different probes, etc.), or a combination of both. As an example, the measurement of abundance of a gene transcript can be a value obtained using an Affymetrix® GeneChip® to measure hybridization to the transcript.

In another embodiment, the expression profile is a differential expression profile comprising differential measurements of a plurality of transcripts in a sample derived from the patient versus measurements of the plurality of transcripts in a reference sample, e.g., a cell sample of normal cells. Each differential measurement in the profile can be but is not limited to an arithmetic difference, a ratio, or a log(ratio). As an example, the measurement of abundance of a gene transcript can be a value for the transcript obtained using an ink-jet array or a cDNA array in a two-color measurement. In a preferred embodiment, the reference sample comprise target polynucleotide molecules from normal cell samples (i.e., cell sample, e.g., bone marrow or peripheral blood, from those not afflicted with CML). In another preferred embodiment, the reference sample comprise target polynucleotide molecules from cell samples, e.g., bone marrow or peripheral blood, from chronic phase CML patients.

The invention also provides methods and computer systems for evaluating the progression of CML in a patient based on a measured marker profile comprising measurements of the markers of the present invention, e.g., an expression profile comprising measurements of transcripts of at least some of the genes listed in Tables 1a and/or 1b, e.g., at least 5, 10, 20, 30, 40, 50, 60, 70, 80, or 100 in Tables 1a and/or 1b or functional equivalents of such genes, wherein at least 1, 2, 3, 5 or 10 genes are from Table 1a. The methods and systems of the invention use a progression classifier for evaluating the progression of CML. The progression classifier can be based on any appropriate pattern recognition method (such as those described in Section 5.2) that receives an input comprising a marker profile and provides an output comprising data indicating which phase the patient belongs, i.e., chronic phase or advanced phase. The progression classifier can be constructed with training data from a plurality of CML patients for whom marker profiles and progression status are known. The plurality of patients used for training the progression classifier is also referred to herein as the training population. The training data comprise for each patient in the training population (a) a marker profile comprising measurements of gene products of a plurality of genes, respectively, in an appropriate cell sample, e.g., a bone marrow or peripheral blood sample, taken from the patient; and (b) progression status information (e.g., the CML phase of the patient). Various progression classifiers that can be used in conjunction with the present invention are described in Section 5.2., infra. In some embodiments, additional patients having known marker profiles and progression status can be used to test the accuracy of the progression classifier obtained using the training population. Such additional patients are also called "the testing population."

The markers in the marker sets are selected based on their ability to discriminate patients having different CML phases in a plurality of CML patients for whom the progression status are known. Various methods can be used to evaluate the correlation between marker levels and CML progression. For example, genes whose expression levels are significantly different across patients in different CML phases can be identified using an appropriate statistical method, e.g., ANOVA.

The invention also provides methods and compositions for treating a patient having CML by modulating, e.g., enhancing or reducing, the expression and/or activities of one or more CML progression genes and/or target genes and/or their gene products. The invention also provides methods and compositions for treating a patient having CML by modulating, e.g., enhancing or reducing, certain CML pathways that involve in CML progression and response. The CML progression genes include those genes listed in Tables 2a and 2b. The CML target genes include those genes listed in Tables 5a and 5b. The CML pathways include FLT3; Rras2; beta-catenin; and SOCS2. The invention also provides methods and compositions for treating a patient having CML by modulating, e.g., enhancing or reducing, certain proteosomes and chaperone proteins. The invention also provides methods and compositions for treating a patient having CML by modulating genes controlled by a promoter selected from the group consisting of the following MZF, delta EF1, SPI-B, Yin Yang, and Ahr-ARNT. The invention also provides methods and compositions for treating a patient having CML by modulating, e.g., reducing, the expression and/or activity of CD47. The invention also provides methods and compositions for treating a patient having CML by targeting PRAME. The invention is based, at least in part, on the identification of aberrant regulation of these genes and pathways in CML.

Thus, the invention provides methods and compositions for treating CML by modulating the expression and/or activity of CML progression genes and/or CML target genes and/or their gene products, and/or by modulating interactions of the CML progression genes and/or target genes and/or their gene products with other proteins or molecules, e.g., substrates. The methods and compositions can be used for treating CML patient who exhibit aberrant regulation in such CML progression/target genes. Thus, such methods and compositions can be used in conjunction with imatinib mesylate. In one embodiment, the expression of one or more of the CML progression/target genes is modulated, e.g., reduced or enhanced, to treat a CML patient exhibiting aberrant regulation of these CML progression/target genes. Such modulation can be achieved by, e.g., using siRNA, antisense nucleic acid, ribozyme, and/or triple helix forming nucleic acid that target the CML progression/target genes. In another embodiment, the activity of one or more CML progression/target proteins is modulated, e.g., reduced or enhanced, to enhance the effects of chemotherapy agents. Such modulation can be achieved by, e.g., using antibodies, peptide molecules, and/or small molecules that target a CML progression/target protein.

The invention also provides methods and compositions for treating CML by modulating the expression and/or activity of imatinib mesylate resistance genes and/or their gene products, and/or by modulating interactions of the IM-resistance genes and/or their gene products with other proteins or molecules, e.g., substrates, in combination of imatinib mesylate. In one embodiment, the expression of one or more of the IM-resistance genes is modulated, e.g., reduced or enhanced, to treat a CML patient undergoing imatinib mesylate treatment. Such modulation can be achieved by, e.g., using siRNA, antisense nucleic acid, ribozyme, and/or triple helix forming nucleic acid that target the imatinib mesylate genes. In another embodiment, the activity of one or more imatinib mesylate proteins is modulated, e.g., reduced or enhanced, to enhance the effects of chemotherapy agents. Such modulation can be achieved by, e.g., using antibodies, peptide molecules, and/or small molecules that target imatinib mesylate proteins.

The invention also provides methods and compositions for utilizing CML progression/target genes or IM-resistance genes, and/or their products for screening for agents that modulate their expression and/or activity and/or modulating their interactions with other proteins or molecules. Agents that modulate expression and/or activity of CML progression/target genes can be used for treating CML patient exhibiting aberrant regulation of one or more CML progression/target genes. Agents that modulate expression and/or activity of IM-resistance genes can be used in combination with IM for treating CML patient exhibiting resistance to IM treatment. Thus, the invention provides methods and compositions for utilizing CML progression/target genes and gene products for screening for agents that are useful in modulating expression and/or activity of CML progression/target genes or IM resistance genes and/or their products and/or modulating their interactions with other proteins or molecules in a CML patient exhibiting aberrant regulation of one or more CML progression/target genes or IM resistance genes. The compositions of the invention include but not limited to siRNA, antisense nucleic acid, ribozyme, triple helix forming nucleic acid, antibody, peptide or polypeptide molecules, and small organic or inorganic molecules.

The present invention also provides methods and compositions for identifying other extra- or intra-cellular molecules, e.g., genes and proteins, which interacts with the CML progression/target genes or IM resistance genes, and/or their gene products, and/or CML progression pathways. The present invention also provides methods and compositions for treating CML by modulating such cellular constituents and/or pathways.

As used herein, a patient is an animal having CML. The patient can be but is not limited to a human, or, in a veterinary context, from non-human animals such as ruminants, horses, swine or sheep, or from domestic companion animals such as felines and canines. In a preferred embodiment, the patient is a human patient. Suitable samples that can be used in conjunction with the present invention include but are not limited to bone marrow samples and peripheral blood samples.

5.1. Genes Associated with CML Progression and Response

The invention provides molecular marker sets (of genes) that can be used for evaluating progression and/or imatinib resistance in a CML patient based on a profile of the markers in the marker set (containing measurements of marker gene products).

Tables 1a and 1b list genes that are differentially expressed across different phases of CML. This set of genes is called the phase reporter geneset. The phase reporter genes are identified by their SEQ ID NOs in Tables 1a and 1b. Tables 1a and 1b also listed for each gene the log ratio of expression level of the gene in samples from patients of a particular phase (e.g., CP, AP, or BC) versus expression level of the gene in a pool of CML bone marrow samples from chronic phase patients. Each log ratio column thus contains expression levels of markers for a particular phase. Information for these genes is presented in Table 8. In Table 8, the following information is presented for each gene: gene identifier (column 1), gene name (column 2), the SEQ ID NO of the sequence of the gene (column 3), and the SEQ ID NO of the probe sequence used in the present application (column 4). The first column of Table 8 shows the identifiers of genes disclosed in the application. The term "SUBS" is shorthand for substance identifier. For those genes listed in Table 8 that have a GenBank® accession number, the GenBank® accession number is listed. For those genes in Table 8 that do not have a GenBank® Accession No, the Contig ID numbers of the transcript sequences in the Phil Green assembly (Nat Genet 2000 June; 25(2):232-4) is listed. Phil Green's group at the University of Washington assembled ESTs from the Washington University-Merck Human EST Project and CGAP archives. Analysis of expressed sequence tags indicates 35,000 human genes (Nat Genet 2000 June; 25(2):232-4). This assembly, dated Mar. 17, 2000, resulted in 62,064 contigs representing 795,000 ESTs. These contigs have the word "contig" included in their identifiers. Table 1a lists phase reporters that were not disclosed in U.S. Patent Application Publication 2003/01044026 A1, dated Jun. 5, 2003. Table 1b lists phase reporters that were also identified in U.S. Patent Application Publication 2003/01044026 A1, dated Jun. 5, 2003.

TABLE 1a phase reporter genes

| SEQ ID NO | log(ratio) CP | log(ratio) AP | log(ratio) BC |
|---|---|---|---|
| 1 | −0.00406 | 0.196563 | 0.331631 |
| 2 | −0.013036 | 0.331191 | 0.13619 |
| 3 | −0.01517 | −0.1969 | −0.51997 |
| 4 | −0.01226 | 0.234703 | 0.506317 |
| 5 | −0.01055 | −0.11513 | −0.25239 |
| 6 | 0.02333 | 0.2234 | 0.385294 |
| 7 | 0.001109 | −0.04225 | −0.38922 |
| 8 | 0.022178 | 0.320491 | 0.362686 |
| 9 | −0.01332 | −0.22505 | −0.26552 |
| 10 | 0.002491 | 0.107514 | 0.40248 |
| 11 | −0.03342 | −0.12983 | −0.34856 |
| 12 | −0.02396 | −0.1739 | −0.56037 |
| 13 | 0.004316 | −0.16534 | −0.15954 |
| 14 | −0.00225 | 0.464357 | 0.637155 |
| 15 | −0.06413 | −0.10146 | −0.58794 |
| 16 | 0.009128 | 0.235874 | 0.469511 |
| 17 | 0.020236 | 1.123603 | 0.742981 |
| 18 | 0.016214 | 0.159637 | 0.392829 |
| 19 | −0.04723 | −0.47509 | −1.36264 |
| 21 | −0.01095 | 0.232221 | 0.294685 |
| 22 | 0.012172 | 0.427707 | 0.729027 |
| 23 | −0.01999 | −0.21291 | −0.36149 |
| 24 | −0.00972 | −0.14706 | −0.4052 |
| 25 | 0.004981 | −0.21328 | −0.37135 |
| 26 | −0.02611 | −0.30231 | −0.45226 |
| 27 | 0.010514 | 0.338824 | 0.434019 |
| 29 | −0.02088 | −0.283 | −0.45987 |
| 30 | −0.00198 | −0.11265 | −0.28724 |
| 31 | 0.023577 | 0.770737 | 0.690215 |
| 32 | 0.008671 | −0.0801 | −0.28421 |
| 33 | 0.012103 | −0.15124 | −0.15019 |
| 34 | 0.010651 | −0.14341 | −0.515 |
| 35 | −0.00126 | 0.010489 | 0.264385 |
| 36 | 0.027348 | 0.34774 | 0.624742 |
| 37 | 0.033762 | 0.213053 | 0.520588 |
| 38 | 0.003765 | −0.14306 | −0.39624 |

TABLE 1a-continued phase reporter genes

| SEQ ID NO | log(ratio) CP | log(ratio) AP | log(ratio) BC |
|---|---|---|---|
| 39 | 0.033025 | 0.281292 | 0.406565 |
| 40 | −0.06315 | −0.28017 | −1.14257 |
| 41 | 0.007748 | 0.09581 | 0.335903 |
| 42 | −0.01732 | −0.09377 | −0.68791 |
| 43 | 0.018086 | −0.22492 | −0.285 |
| 44 | 0.014232 | −0.27373 | −0.31289 |
| 45 | 0.036197 | 0.142295 | 0.466937 |
| 46 | −0.01022 | 0.299737 | 0.425197 |
| 47 | 0.006822 | 0.199214 | 0.443601 |
| 48 | 0.021602 | 0.186392 | 0.33675 |
| 49 | −0.03649 | −0.26722 | −0.49009 |
| 52 | 0.008248 | 0.502971 | 0.507442 |
| 53 | 0.040187 | 0.687502 | 0.564688 |
| 54 | −0.00051 | −0.10576 | −0.40709 |
| 55 | −0.01352 | −0.22612 | −0.49128 |
| 57 | −0.05265 | 0.433648 | 0.40219 |
| 58 | 0.019239 | 0.187127 | 0.325353 |
| 59 | 0.006451 | −0.22186 | −0.18506 |
| 60 | 0.010201 | 0.615117 | 1.017473 |
| 61 | 0.013254 | −0.23449 | −0.26153 |
| 62 | 0.012036 | −0.20146 | −0.36216 |
| 63 | 0.018656 | 0.262829 | 0.530868 |
| 64 | −0.01623 | −0.1428 | −0.50841 |
| 66 | −0.00346 | −0.1026 | −0.30257 |
| 67 | 0.009841 | 0.335299 | 0.527591 |
| 68 | 0.009665 | 0.97143 | 0.990692 |
| 69 | −0.03517 | 0.36588 | 0.442864 |
| 71 | 0.005961 | −0.17466 | −0.20803 |
| 73 | −0.00646 | −0.25708 | −0.21749 |
| 74 | −0.018621 | 0.110352 | −0.541362 |
| 75 | −0.00408 | −0.21342 | −0.26897 |
| 76 | 0.009207 | 0.769453 | 0.850508 |
| 78 | 0.0123 | 0.167805 | 0.337085 |
| 79 | 0.00674 | −0.17218 | −0.25414 |
| 80 | −0.00232 | −0.13768 | −0.25962 |
| 81 | −0.04268 | −0.09565 | −0.76123 |
| 82 | −0.00889 | −0.18131 | −0.3448 |
| 83 | 0.00964 | 0.139417 | 0.328274 |
| 84 | −0.03477 | 0.147022 | −0.67052 |
| 85 | −0.0546 | −0.22956 | −1.32988 |
| 86 | −0.01987 | −0.41057 | −0.63814 |
| 87 | −0.00053 | −0.16512 | −0.19246 |
| 89 | 0.029134 | 0.166704 | 0.399066 |
| 90 | −0.00832 | −0.13645 | −0.3186 |
| 92 | 0.037155 | 0.284153 | 0.64532 |
| 94 | −0.01142 | −0.13881 | −0.3608 |
| 95 | 0.01125 | 0.10955 | 0.227757 |
| 96 | 0.012527 | 0.229295 | 0.293851 |
| 98 | 0.060257 | 0.952532 | 0.999368 |
| 100 | −0.0643 | −0.33585 | −0.59098 |
| 101 | 0.009363 | 0.184372 | 0.293381 |
| 102 | −0.0128 | −0.2329 | −0.54422 |
| 103 | 0.019799 | 0.472863 | 0.54563 |
| 104 | 0.039449 | 0.415733 | 0.576671 |
| 106 | 0.010496 | −0.12076 | −0.18666 |
| 107 | 0.011423 | −0.16555 | −0.23653 |
| 108 | −0.08443 | 1.178885 | 0.802082 |
| 109 | 0.013994 | 0.264328 | 0.401994 |
| 110 | 0.04438 | 0.40653 | 0.580366 |
| 111 | 0.027108 | 0.265955 | 0.604212 |
| 112 | 0.003332 | −0.25986 | −0.29846 |
| 113 | −0.01029 | −0.26712 | −0.2846 |
| 114 | −0.05586 | −0.21334 | −0.82293 |
| 115 | 0.009594 | 0.017981 | 0.208686 |
| 117 | −0.01023 | 0.452998 | 0.673941 |
| 118 | −0.00659 | 0.490457 | 0.517515 |
| 119 | −0.02254 | 0.744289 | 0.818592 |
| 120 | −0.01441 | −0.29009 | −0.5309 |
| 121 | −0.01153 | −0.19616 | −0.33788 |
| 122 | 0.028602 | 0.405315 | 0.525104 |
| 123 | −0.00564 | 0.355702 | 0.57473 |
| 124 | 0.005664 | 0.194653 | 0.230888 |
| 125 | 0.029794 | 0.454278 | 0.726423 |
| 126 | −0.01071 | −0.33686 | −0.43968 |
| 127 | 0.037702 | 0.541984 | 0.729726 |
| 128 | −0.00753 | 0.139932 | 0.246875 |
| 129 | 0.024429 | 1.375049 | 1.029358 |
| 130 | −0.01338 | −0.13678 | −0.28729 |
| 131 | 0.014108 | 0.432232 | 0.771513 |
| 132 | 0.026976 | 0.425544 | 0.61667 |
| 133 | 0.024633 | 0.146129 | 0.39073 |
| 135 | −0.00713 | −0.09868 | −0.64744 |
| 136 | −0.03239 | −0.08145 | −0.37526 |
| 137 | −0.04003 | −0.24301 | −0.62499 |
| 138 | −0.00308 | 0.502829 | 0.723824 |
| 139 | 0.006495 | 0.731382 | 0.863995 |
| 140 | 0.001806 | −0.20936 | −0.37679 |
| 141 | −0.03144 | −0.20901 | −0.55634 |
| 143 | 0.007968 | −0.15803 | −0.23468 |
| 144 | −0.03705 | −0.14512 | −0.62385 |
| 145 | 0.027758 | 0.144793 | 0.533543 |
| 146 | −0.01241 | −0.08289 | −0.71342 |
| 147 | 0.024977 | −0.11774 | −0.37273 |
| 148 | −0.03021 | −0.24989 | −0.41756 |
| 149 | −0.07893 | −0.2035 | −1.0393 |
| 151 | 0.000992 | 0.489396 | 0.562018 |
| 152 | −0.03269 | −0.19994 | −0.50103 |
| 153 | −0.01351 | −0.07093 | −0.35161 |
| 154 | 0.020101 | 0.132417 | 0.359255 |
| 156 | −0.02182 | −0.18751 | −0.49204 |
| 157 | 0.00543 | −0.2313 | −0.38327 |
| 159 | −0.02675 | −0.26775 | −0.37637 |
| 160 | −0.10326 | −0.41976 | −1.24875 |
| 161 | −0.06485 | −0.23089 | −1.08897 |
| 162 | 0.010219 | −0.24712 | −0.31122 |
| 163 | 0.00622 | 0.175804 | 0.334146 |
| 164 | 0.008023 | 0.275526 | 0.371384 |
| 165 | −0.0136 | −0.18292 | −0.50396 |
| 166 | −0.04425 | −0.16366 | −0.88014 |
| 167 | 0.012461 | 0.406484 | 0.521279 |
| 168 | −0.00562 | −0.17893 | −0.63614 |
| 169 | −0.0054 | 0.165872 | 0.354167 |
| 170 | −0.02256 | −0.17498 | −0.38989 |
| 172 | 0.011677 | 0.261214 | 0.340198 |
| 173 | 0.020232 | 0.307823 | 0.428941 |
| 175 | 0.013073 | 0.300556 | 0.463354 |
| 176 | 0.003276 | 0.347293 | 0.31246 |
| 178 | 0.009824 | 0.232776 | 0.381628 |
| 179 | −0.02289 | −0.25739 | −0.3302 |
| 180 | 0.009575 | 0.390154 | 0.620031 |
| 181 | 0.006626 | 0.466249 | 0.426852 |
| 182 | 0.006874 | −0.17448 | −0.30214 |
| 183 | −0.04255 | −0.18274 | −0.56752 |
| 185 | 0.022986 | 0.276936 | 0.409773 |
| 186 | 0.035638 | 0.396599 | 0.57451 |
| 187 | −0.03048 | 0.29151 | 0.498925 |
| 188 | 0.018337 | 0.150771 | 0.433259 |
| 189 | 0.019129 | 0.214669 | 0.445425 |
| 192 | −0.00127 | −0.15435 | −0.14901 |
| 193 | 0.02795 | 0.198928 | 0.288937 |
| 194 | 0.007888 | −0.17921 | −0.21534 |
| 196 | 0.035064 | 0.124182 | 0.42622 |
| 197 | −0.00783 | 0.341137 | 0.350515 |
| 198 | −0.01383 | −0.24055 | −0.43808 |
| 200 | −0.0088 | −0.19251 | −0.40881 |
| 201 | 0.015369 | 0.124961 | 0.366843 |
| 202 | 0.012127 | 0.215212 | 0.262119 |
| 203 | −0.01782 | 0.439568 | 0.95044 |
| 205 | −0.00924 | 0.268211 | 0.43449 |
| 206 | −0.01689 | 0.247457 | 0.407007 |
| 207 | 0.009984 | −0.20509 | −0.24277 |
| 208 | 0.00118 | 0.267559 | 0.335573 |
| 209 | −0.06306 | −0.26661 | −0.33283 |
| 210 | −0.0089 | −0.26158 | −0.69113 |
| 211 | −0.02429 | −0.21795 | −0.69236 |
| 212 | −0.00292 | 0.201049 | 0.501509 |
| 213 | −0.01096 | 0.549883 | 0.588095 |
| 214 | −0.00632 | −0.05677 | −0.38403 |
| 215 | 0.013808 | 0.216326 | 0.45018 |
| 216 | −0.02067 | 0.993831 | 0.857242 |

TABLE 1a-continued phase reporter genes

| SEQ ID NO | log(ratio) CP | log(ratio) AP | log(ratio) BC |
|---|---|---|---|
| 217 | 0.030504 | 0.237509 | 0.318043 |
| 218 | −0.01132 | −0.3714 | −0.32207 |
| 219 | 0.024379 | 0.105073 | 0.271123 |
| 220 | −0.04224 | −0.24384 | −0.67924 |
| 221 | 0.00743 | 0.24524 | 0.402431 |
| 222 | −0.00456 | 0.377328 | 0.497584 |
| 223 | −0.00227 | 0.290412 | 0.612027 |
| 224 | 0.000149 | −0.22094 | −0.27218 |
| 225 | −0.00048 | −0.21954 | −0.27035 |
| 226 | 0.020037 | 0.244055 | 0.263423 |
| 227 | 0.005396 | −0.1374 | −0.20983 |
| 228 | −0.02345 | −0.26901 | −0.57294 |
| 229 | −0.00222 | 0.326381 | 0.351552 |
| 230 | −0.00805 | 0.563987 | 0.764354 |
| 231 | 0.00523 | 0.506345 | 0.808013 |
| 232 | 0.035061 | 0.219785 | 0.40561 |
| 233 | 0.013849 | −0.15255 | −0.43366 |
| 234 | −0.00462 | −0.22522 | −0.25117 |
| 235 | −0.00656 | −0.33242 | −0.94825 |
| 236 | −0.02885 | −0.00068 | −0.32216 |
| 237 | 0.032626 | 0.07941 | 0.332713 |
| 238 | −0.05042 | −0.25277 | −1.18988 |
| 239 | −0.05805 | −0.33763 | −0.85786 |
| 240 | −0.03475 | −0.31239 | −0.42272 |
| 241 | −0.00172 | −0.13603 | −0.18037 |
| 242 | 0.014459 | 0.27539 | 0.475543 |
| 244 | −0.00314 | −0.1324 | −0.3129 |
| 245 | 0.015445 | 0.215709 | 0.389195 |
| 247 | −0.00129 | 0.045009 | 0.271915 |
| 248 | 0.022773 | 0.755832 | 0.762127 |
| 249 | −0.00437 | 0.63018 | 0.875263 |
| 250 | 0.028168 | 0.410753 | 0.722373 |
| 251 | −0.00566 | 0.043714 | 0.278866 |
| 252 | −0.011159 | −0.181168 | −0.338022 |
| 253 | 0.003149 | 0.380909 | 0.533681 |
| 255 | −0.0062 | −0.31339 | −0.36157 |
| 256 | 0.03695 | 0.259542 | 0.377038 |
| 257 | −0.01933 | −0.28626 | −0.26047 |
| 258 | −0.03788 | 0.686262 | 0.905816 |
| 259 | 0.030002 | 0.220485 | 0.371893 |
| 260 | 0.036663 | 0.518139 | 0.756959 |
| 261 | 0.002136 | −0.013939 | 0.252784 |
| 262 | −0.00929 | −0.3146 | −0.33185 |
| 263 | 0.002577 | −0.2136 | −0.26803 |
| 264 | 0.025124 | 0.183856 | 0.351043 |
| 265 | 0.017567 | −0.1399 | −0.1726 |
| 266 | −0.02625 | −0.19264 | −0.32146 |
| 268 | −0.00566 | −0.26083 | −0.47188 |
| 270 | −0.00065 | −0.21267 | −0.22762 |
| 271 | −0.03035 | −0.20616 | −1.26887 |
| 272 | 0.011657 | −0.02278 | −0.48484 |
| 273 | −0.01594 | 0.063149 | −0.5003 |
| 274 | −0.03779 | −0.29016 | −0.73186 |
| 276 | −0.00502 | −0.10018 | −0.26137 |
| 277 | −0.038 | −0.40089 | −1.25651 |
| 278 | −0.06888 | −0.20805 | −1.0999 |
| 279 | 0.012839 | −0.17955 | −0.37213 |
| 280 | −0.00925 | −0.14564 | −0.2323 |
| 281 | 0.001026 | −0.09417 | −0.42691 |
| 282 | 0.037145 | 0.537281 | 0.683985 |
| 284 | −0.12422 | −0.39967 | −0.73152 |
| 285 | −0.00167 | 0.173409 | 0.635898 |
| 286 | 0.021359 | 0.510842 | 0.876009 |
| 287 | 0.004045 | 0.040739 | −0.32067 |
| 288 | 0.022173 | 0.185017 | 0.362062 |
| 289 | −0.01363 | 0.295039 | 0.463615 |
| 290 | 0.003611 | 0.30309 | 0.559536 |
| 291 | 0.004575 | 0.516875 | 0.753323 |
| 293 | −0.08872 | −0.344 | −0.57833 |
| 294 | 0.001582 | −0.08399 | −0.4561 |
| 295 | −0.02727 | −0.08523 | −0.57337 |
| 296 | 0.017609 | −0.10028 | −0.13923 |
| 297 | −0.00156 | 0.205813 | 0.568643 |
| 298 | −0.05053 | −0.21837 | −0.42199 |
| 299 | −0.00722 | −0.07371 | 0.267236 |
| 300 | −0.0072 | 0.081384 | 0.261428 |
| 301 | 0.011586 | 0.316703 | 0.603077 |
| 302 | 0.046624 | 0.148924 | 0.379405 |
| 303 | −0.01548 | −0.27466 | −0.39079 |
| 304 | 0.013524 | 0.256952 | 0.367345 |
| 305 | −0.00086 | −0.14331 | −0.77061 |
| 306 | 0.004258 | 0.419788 | 0.50798 |
| 307 | 0.006142 | 0.205577 | 0.341327 |
| 308 | 0.023789 | 0.207632 | 0.417747 |
| 310 | 0.007916 | 0.369139 | 0.409188 |
| 311 | −0.01836 | −0.20108 | −0.71669 |
| 312 | −0.006268 | −0.169392 | −0.415121 |
| 313 | −0.00495 | −0.13587 | −0.78354 |
| 314 | −0.0011 | 0.08784 | 0.46325 |
| 315 | 0.022841 | 0.088006 | 0.320199 |
| 316 | −0.02247 | −0.02247 | −0.59153 |
| 317 | 0.006673 | 0.216686 | 0.362071 |
| 318 | 0.004282 | 0.212988 | 0.362294 |
| 319 | 0.00959 | 0.25789 | 0.445202 |
| 320 | 0.004401 | 0.323433 | 0.426867 |
| 321 | 0.017293 | 0.264073 | 0.351815 |
| 322 | 0.005 | 0.356068 | 0.595108 |
| 323 | −0.00155 | 0.25112 | 0.276408 |
| 324 | −0.00324 | −0.13033 | −0.72284 |
| 325 | 0.0084 | 0.176745 | 0.433833 |
| 326 | −0.02092 | −0.09038 | −0.49155 |
| 327 | −0.01983 | 0.570832 | 0.891189 |
| 328 | 0.007403 | 0.218308 | 0.328162 |
| 329 | 0.002464 | −0.29977 | −0.4368 |
| 330 | −0.00406 | 0.322086 | 0.397844 |
| 331 | −0.00096 | 0.293121 | 0.435914 |
| 332 | −0.03766 | −0.12709 | −0.79553 |
| 333 | 0.007746 | 0.179449 | 0.355948 |
| 334 | 0.001146 | 0.201923 | 0.364199 |
| 335 | −0.0092 | −0.11216 | −0.24813 |
| 336 | 0.002538 | 0.255332 | 0.328868 |
| 338 | −0.01378 | 0.580861 | 0.677954 |
| 339 | −0.01099 | 0.437624 | 0.71671 |
| 340 | −0.04397 | −0.28419 | −0.47451 |
| 341 | 0.002115 | 0.350031 | 0.562431 |
| 344 | 0.011013 | 0.359311 | 0.387564 |
| 345 | −0.0544 | −0.40219 | −0.96425 |
| 346 | 0.00386 | −0.16004 | −0.21088 |
| 347 | 0.008691 | −0.12593 | −0.2973 |
| 348 | 0.031093 | 0.329318 | 0.780388 |
| 349 | −0.02475 | 0.26498 | 0.691058 |
| 350 | −0.00404 | 0.311488 | 0.516583 |
| 351 | −0.00927 | 0.607415 | 0.932839 |
| 352 | 0.022615 | 0.310721 | 0.407642 |
| 353 | 0.029353 | 0.284248 | 0.464804 |
| 354 | 0.027651 | 0.20546 | 0.357579 |
| 355 | −0.02613 | −0.20506 | −0.37711 |
| 356 | −0.00083 | 0.314884 | 0.564315 |
| 357 | −0.03262 | −0.16231 | −0.51277 |
| 358 | 0.009931 | 0.424744 | 0.445465 |
| 359 | 0.000838 | −0.18535 | −0.36657 |
| 360 | −0.00394 | 0.344407 | 0.324467 |
| 361 | 0.013027 | −0.22952 | −0.45254 |
| 362 | 0.012504 | 0.505496 | 0.881425 |
| 363 | 0.004492 | −0.184 | −0.35598 |
| 364 | 0.018433 | 0.104271 | 0.281978 |
| 366 | 0.023631 | 0.179526 | 0.451027 |
| 367 | 0.011627 | 0.434004 | 0.716856 |
| 368 | 0.002949 | 0.516501 | 0.670302 |
| 369 | 0.015105 | −0.30705 | −0.467622 |
| 373 | −0.02652 | 0.287902 | 0.471974 |
| 374 | 0.006262 | −0.12699 | −0.20681 |
| 375 | −0.03478 | −0.32675 | −0.65035 |
| 376 | 0.023213 | 0.37658 | 0.448167 |
| 378 | 0.003855 | −0.20696 | −0.30833 |
| 379 | 0.011972 | 0.153175 | 0.287232 |
| 380 | 0.03818 | 0.44812 | 0.568722 |
| 381 | −0.01575 | −0.33744 | −0.32145 |
| 382 | 0.009525 | 1.055649 | 1.229694 |
| 383 | −0.01645 | 0.377429 | 0.585175 |

TABLE 1a-continued phase reporter genes

| SEQ ID NO | log(ratio) CP | log(ratio) AP | log(ratio) BC |
|---|---|---|---|
| 384 | 0.003458 | −0.13346 | −0.32546 |
| 385 | −0.02648 | 0.391455 | 0.376356 |
| 387 | 0.011792 | 0.177323 | 0.238369 |
| 388 | 0.002507 | 0.266779 | 0.401403 |
| 389 | 0.020836 | 0.218151 | 0.367914 |
| 391 | −0.00888 | −0.17832 | −0.22969 |
| 392 | 0.00994 | 0.78201 | 0.698796 |
| 394 | −0.02204 | 0.37983 | 0.574414 |
| 395 | −0.01527 | 0.524632 | 0.73152 |
| 396 | −0.02183 | 0.199521 | 0.458525 |
| 397 | 0.010494 | −0.18981 | −0.23533 |
| 398 | 0.03599 | 0.651468 | 0.783908 |
| 399 | 0.027644 | 0.166253 | 0.382499 |
| 400 | −0.00478 | 0.184165 | 0.341955 |
| 401 | −0.04717 | −0.30622 | −0.91206 |
| 402 | 0.008695 | 0.136421 | 0.315881 |
| 403 | 0.001163 | 0.037698 | 0.202135 |
| 404 | −0.00339 | −0.18226 | −0.2593 |
| 405 | −0.00228 | 0.310556 | 0.465954 |
| 407 | −0.02149 | −0.34683 | −0.42713 |
| 408 | −0.00404 | 0.033405 | 0.262641 |
| 409 | 0.007876 | 0.087487 | 0.30433 |
| 410 | 0.012271 | −0.18684 | −0.35875 |
| 411 | 0.020091 | 0.322311 | 0.477211 |
| 412 | −0.00568 | −0.1428 | −0.3547 |
| 413 | −0.02569 | −0.24238 | −0.87728 |
| 414 | −0.01495 | −0.31741 | −0.28573 |
| 415 | 0.002245 | 0.277985 | 0.577752 |
| 416 | −0.01237 | −0.3593 | −0.27374 |
| 417 | −0.033 | 0.571436 | 0.497539 |
| 418 | 0.007854 | 0.249327 | 0.42565 |
| 419 | 0.019821 | −0.26045 | −0.39006 |
| 420 | 0.03308 | 0.247533 | 0.407783 |
| 421 | 0.020948 | 0.489159 | 0.557808 |
| 422 | −0.00647 | 0.41734 | 0.451584 |
| 423 | 0.019016 | 0.187074 | 0.279317 |
| 424 | 0.056475 | 0.401103 | 0.532501 |
| 425 | 0.005889 | −0.26002 | −0.36426 |
| 427 | 0.009398 | −0.16823 | −0.18166 |
| 428 | −0.02152 | −0.13742 | −0.3652 |
| 429 | −0.00502 | −0.17865 | −0.51519 |
| 430 | −0.02829 | −0.23927 | −0.26731 |
| 431 | 0.006892 | −0.15152 | −0.23519 |
| 432 | −0.01094 | 0.264726 | 0.239472 |
| 433 | 0.00307 | 0.262516 | 0.435894 |
| 434 | 0.006867 | 0.113144 | 0.164129 |
| 435 | 0.008669 | 0.168966 | 0.366591 |
| 436 | −0.02165 | −0.24157 | −0.27957 |
| 437 | −0.02808 | −0.17851 | −0.47493 |
| 438 | −0.01511 | −0.24775 | −0.25327 |
| 439 | −0.00157 | −0.1947 | −0.26853 |
| 440 | 0.004716 | 0.203404 | 0.422278 |
| 441 | −0.00177 | −0.14061 | −0.241 |
| 443 | 0.035531 | 0.500552 | 0.762578 |
| 445 | 0.001111 | −0.22997 | −0.20668 |
| 446 | −0.00966 | 0.262547 | 0.532299 |
| 447 | 0.022051 | −0.17196 | −0.17358 |
| 448 | 0.02208 | −0.20758 | −0.54453 |
| 449 | 0.003789 | −0.26541 | −0.42068 |
| 450 | 0.008518 | −0.27104 | −0.36638 |
| 451 | −0.00455 | 0.256373 | 0.344655 |
| 452 | 0.013363 | 0.201399 | 0.48943 |
| 453 | 0.006363 | −0.42802 | −0.57571 |
| 454 | 0.017816 | 0.463759 | 0.559027 |
| 455 | 0.029497 | 0.923393 | 0.874385 |
| 457 | 0.009285 | 0.270846 | 0.433079 |
| 458 | 0.002975 | 0.285186 | 0.559486 |
| 460 | 0.004206 | −0.25199 | −0.25737 |
| 461 | 0.036278 | 0.309837 | 0.48065 |
| 462 | 0.003674 | −0.24833 | −0.33834 |
| 463 | −0.00922 | 0.135492 | 0.327492 |
| 464 | 0.018334 | −0.16889 | −0.20305 |
| 465 | 0.010683 | 0.454598 | 0.691297 |
| 466 | 0.010724 | 0.689523 | 0.82927 |
| 467 | −0.04167 | −0.0735 | −0.57092 |
| 468 | −0.0225 | −0.36378 | −0.97219 |
| 470 | 0.018621 | 0.350742 | 0.523891 |
| 471 | −0.0407 | −0.25963 | −0.75311 |
| 472 | 0.01964 | 0.389219 | 0.723458 |
| 473 | 0.021469 | 0.508121 | 0.605512 |
| 474 | −0.01762 | −0.15235 | −0.59443 |
| 475 | −0.00014 | 0.056288 | 0.351247 |
| 476 | 0.012152 | 0.609658 | 0.780355 |
| 477 | 0.001236 | 0.31629 | 0.53508 |
| 478 | −0.01143 | −0.18139 | −0.26073 |
| 479 | 0.002234 | −0.16979 | −0.23309 |
| 481 | −0.02373 | −0.30404 | −0.58894 |
| 482 | −0.03178 | −0.32713 | −0.49262 |
| 483 | 0.002809 | −0.10396 | −0.43271 |
| 484 | −0.06435 | −0.19262 | −0.80105 |
| 485 | 0.000478 | 0.19485 | 0.514866 |
| 486 | −0.08957 | −0.12042 | −0.67656 |
| 487 | 0.013939 | −0.24216 | −0.28064 |
| 488 | 0.012644 | 0.129777 | 0.534351 |
| 489 | −0.0039 | 0.452568 | 0.763985 |
| 490 | 0.032225 | 0.697253 | 0.473438 |
| 491 | 0.006365 | −0.13366 | −0.26424 |
| 492 | −0.02582 | −0.14697 | −0.40098 |
| 493 | −0.01329 | 0.347413 | 0.799548 |
| 496 | −0.12522 | −0.40255 | −1.29041 |
| 497 | 0.01042 | −0.2418 | −0.35114 |
| 498 | 0.004399 | 0.251007 | 0.451326 |
| 499 | −0.01108 | −0.24741 | −0.33924 |
| 500 | 0.006845 | −0.13731 | −0.21962 |
| 501 | 0.009869 | 0.486607 | 0.62994 |
| 502 | 0.001451 | −0.16634 | −0.22245 |
| 504 | 0.003354 | 0.428944 | 0.638344 |
| 505 | 0.009145 | 0.541783 | 0.640468 |
| 506 | 0.002222 | 0.244418 | 0.413136 |
| 507 | −0.02701 | −0.27514 | −0.5056 |
| 508 | 0.018613 | 0.223 | 0.514935 |
| 509 | −0.00241 | −0.23143 | −0.26272 |
| 510 | −0.00802 | −0.16617 | −0.43514 |
| 511 | −0.00235 | 0.257971 | 0.453002 |
| 512 | 0.040032 | 0.421433 | 0.627533 |
| 513 | −0.03045 | −0.21394 | −0.69964 |
| 514 | −0.06115 | −0.27077 | −0.83265 |
| 515 | −0.01716 | −0.35696 | −0.63809 |
| 516 | −0.05133 | −0.29445 | −0.52283 |
| 517 | 0.009223 | −0.14528 | −0.19722 |
| 518 | 0.024306 | 0.291688 | 0.612915 |
| 519 | −0.0176 | −0.22202 | −0.31698 |
| 520 | 0.034555 | 0.487855 | 0.723822 |
| 521 | −0.24116 | −0.1809 | −1.51236 |
| 523 | −0.028 | 0.350568 | 0.474606 |
| 524 | −0.01417 | −0.35675 | −0.31506 |
| 525 | 0.005652 | 0.018971 | −0.43584 |
| 526 | −0.00638 | −0.23708 | −0.60635 |
| 527 | 0.024828 | 1.066096 | 1.01296 |
| 528 | −0.01588 | −0.2259 | −0.70248 |
| 529 | 0.005863 | 0.254703 | 0.254473 |
| 530 | 0.006005 | −0.11549 | −0.19425 |
| 532 | −0.03536 | −0.32282 | −0.70578 |
| 533 | 0.003023 | −0.19447 | −0.22887 |
| 534 | −0.00887 | 0.300912 | 0.41484 |
| 535 | −0.02229 | −0.31605 | −0.62805 |
| 536 | −0.01746 | −0.2479 | −0.3707 |
| 537 | 0.007845 | 0.652793 | 0.694802 |
| 538 | −0.018193 | 0.150284 | 0.270979 |
| 539 | 0.002643 | −0.21014 | −0.22848 |
| 540 | −0.10813 | −0.23606 | −1.12333 |
| 541 | −0.0173 | −0.21271 | −0.3248 |
| 542 | 0.019658 | −0.04887 | −0.19164 |
| 543 | 0.005212 | 0.698449 | 1.061987 |
| 544 | 0.049701 | 0.3053 | 0.632118 |
| 545 | −0.01576 | −0.26269 | −0.43173 |
| 546 | −0.00177 | −0.16459 | −0.35064 |
| 547 | 0.004499 | 0.286052 | 0.541283 |
| 548 | −0.00036 | 0.274103 | 0.301037 |
| 549 | 0.007366 | −0.13753 | −0.38447 |

TABLE 1a-continued phase reporter genes

| SEQ ID NO | log(ratio) CP | log(ratio) AP | log(ratio) BC |
|---|---|---|---|
| 550 | −0.04882 | −0.32016 | −0.84231 |
| 551 | −0.0152 | 0.305526 | 0.3174 |
| 552 | −0.02703 | −0.32147 | −0.99173 |
| 553 | −0.05272 | −0.13234 | −0.51801 |
| 554 | 0.018185 | −0.12473 | −0.17948 |
| 555 | 0.017748 | 0.466124 | 0.777913 |
| 556 | 0.008038 | −0.17631 | −0.19837 |
| 557 | 0.000468 | −0.22168 | −0.30063 |
| 558 | −0.11451 | −0.38803 | −0.78032 |
| 559 | −0.0009 | 0.07287 | 0.268041 |
| 560 | 0.028192 | 0.212734 | 0.313642 |
| 561 | −0.12161 | −0.59358 | −1.61579 |
| 562 | −0.007465 | −0.085295 | −0.451408 |
| 563 | 0.002504 | −0.08158 | −0.57774 |
| 564 | 0.024854 | 0.234157 | 0.699992 |
| 565 | −0.013377 | 0.189935 | 0.358398 |
| 566 | 0.006148 | 0.8283 | 0.988152 |
| 567 | 0.001478 | −0.20409 | −0.29234 |
| 569 | 0.013513 | 0.259774 | 0.389554 |
| 570 | 0.002998 | −0.14785 | −0.19082 |
| 572 | −0.04096 | −0.21747 | −0.54585 |
| 573 | 0.027767 | 0.16747 | 0.378448 |
| 574 | 0.019577 | 0.36625 | 0.62085 |
| 575 | 0.00827 | −0.18984 | −0.21404 |
| 577 | 0.041665 | 0.479258 | 0.630781 |
| 578 | −0.01208 | −0.22961 | −0.57036 |
| 579 | 0.020234 | 0.441729 | 0.519404 |
| 580 | −0.01711 | −0.32502 | −0.33935 |
| 581 | −0.05725 | 0.422632 | 0.81318 |
| 582 | −0.0174 | −0.16658 | −0.5001 |
| 583 | 0.021327 | 0.456622 | 0.992707 |
| 584 | 0.015526 | 0.481936 | 0.645218 |
| 585 | 0.025648 | 0.313061 | 0.522952 |
| 586 | −0.00125 | 0.139615 | 0.459749 |
| 587 | 0.003988 | −0.14491 | −0.25971 |
| 588 | −0.14462 | −0.51176 | −0.64378 |
| 589 | −0.00082 | 0.015573 | −0.56675 |
| 590 | 0.02049 | −0.04531 | −0.53244 |
| 591 | −0.00039 | 0.534262 | 0.755197 |
| 592 | −0.04775 | −0.24053 | −0.50456 |
| 593 | −0.02065 | −0.27304 | −0.2768 |
| 594 | 0.018819 | 0.331182 | 0.288672 |
| 595 | −0.00063 | −0.17735 | −0.18189 |
| 596 | −0.027369 | −0.300983 | −0.676728 |
| 597 | 0.004781 | −0.26501 | −0.26476 |
| 598 | −0.00272 | −0.36897 | −0.48838 |
| 599 | −0.01164 | −0.27727 | −0.44042 |
| 601 | −0.00966 | −0.10751 | −0.27903 |
| 602 | −0.02947 | 0.152602 | 0.288592 |
| 603 | −0.00852 | −0.25099 | −0.30067 |
| 604 | 0.012565 | −0.18969 | −0.12342 |
| 606 | −0.04446 | −0.08468 | −0.76458 |
| 607 | 0.005295 | 0.140745 | 0.305385 |
| 608 | 0.048404 | 0.392827 | 0.678865 |
| 609 | −0.00583 | −0.2845 | −0.22576 |
| 610 | 0.008709 | −0.12867 | −0.19183 |
| 611 | 0.014751 | 0.152297 | 0.272206 |
| 612 | −0.04563 | 0.157375 | −0.63129 |
| 613 | 0.001208 | 0.545143 | 0.478695 |
| 614 | −0.01227 | −0.34599 | −0.3068 |
| 616 | 0.008303 | 0.310116 | 0.334407 |
| 617 | 0.021572 | 0.234966 | 0.409616 |
| 618 | −0.02922 | −0.28728 | −0.30017 |
| 619 | −0.0576 | −0.28502 | −0.75427 |
| 620 | 0.036486 | 0.263999 | 0.326197 |
| 621 | −0.01196 | −0.15869 | −0.38876 |
| 623 | 0.019376 | 0.276659 | 0.32361 |
| 624 | −0.00797 | −0.19147 | −0.34348 |
| 625 | −0.05054 | −0.19751 | −0.74917 |
| 626 | −0.0001 | −0.16253 | −0.57576 |
| 627 | 0.014376 | −0.11856 | −0.19535 |
| 629 | 0.004473 | 0.221721 | 0.415194 |
| 630 | 0.02181 | −0.17889 | −0.25501 |
| 631 | −0.01378 | −0.18604 | −0.36808 |
| 632 | −0.03351 | −0.11657 | −1.07136 |
| 633 | 0.020992 | 0.000039 | −0.31313 |
| 634 | 0.05228 | 0.356045 | 0.555225 |
| 635 | −0.01133 | −0.35665 | −0.46195 |
| 636 | −0.0052 | −0.22931 | −0.26284 |
| 637 | 0.034009 | 0.16114 | 0.537473 |
| 638 | 0.01303 | 0.557482 | 0.95039 |
| 639 | 0.000269 | 0.261943 | 0.453719 |
| 640 | 0.007824 | 0.514375 | 0.445489 |
| 641 | 0.004039 | −0.28474 | −0.69362 |
| 642 | −0.02654 | −0.19434 | −0.28361 |
| 643 | 0.004215 | 0.259226 | 0.454328 |
| 644 | 0.011035 | −0.188829 | −0.236191 |
| 645 | 0.006618 | −0.23616 | −0.18958 |
| 646 | 0.005768 | −0.1888 | −0.18372 |
| 647 | 0.000143 | −0.204 | −0.23115 |
| 648 | 0.029086 | 0.795172 | 0.920315 |
| 649 | 0.011574 | −0.26945 | −0.42427 |
| 650 | 0.056019 | 0.850201 | 0.989802 |
| 651 | 0.01505 | −0.04939 | −0.35871 |
| 652 | 0.01302 | 0.069293 | 0.310582 |
| 653 | 0.034272 | −0.31715 | −0.52764 |
| 654 | −0.0085 | −0.16306 | −0.33049 |
| 655 | 0.027666 | 0.201708 | 0.430175 |
| 656 | 0.021961 | 0.398141 | 0.388252 |
| 657 | 0.010863 | 0.232244 | 0.38243 |
| 658 | 0.002158 | 0.441887 | 0.807217 |
| 660 | −0.02496 | −0.23046 | −0.53717 |
| 661 | −0.02486 | −0.27484 | −0.88262 |
| 666 | 0.006007 | 0.429414 | 0.417403 |
| 667 | −0.05507 | −0.22247 | −0.84766 |
| 668 | 0.00216 | 0.118185 | 0.260937 |
| 669 | 0.038854 | 0.391818 | 0.596807 |
| 671 | −0.0359 | −0.25121 | −1.33794 |
| 672 | 0.031714 | 0.128319 | 0.274932 |
| 673 | −0.00491 | −0.32528 | −0.27831 |
| 674 | −0.01249 | −0.29579 | −0.93449 |
| 677 | 0.03155 | 0.28669 | 0.43691 |
| 678 | −0.00818 | −0.23129 | −0.44976 |
| 679 | −0.00242 | −0.23058 | −0.26857 |
| 680 | 0.049757 | 0.269209 | 0.366683 |
| 681 | 0.001602 | 0.047578 | −0.52406 |
| 682 | 0.022865 | 0.544886 | 0.684953 |
| 683 | −0.000051 | −0.16042 | −0.34528 |
| 684 | −0.0076 | −0.28875 | −0.37374 |
| 685 | −0.10296 | −0.46829 | −1.01184 |
| 686 | 0.003542 | 0.623074 | 1.007803 |
| 687 | 0.013924 | 0.275094 | 0.562663 |
| 688 | −0.00395 | −0.06428 | −0.4539 |
| 689 | 0.00922 | 0.871387 | 1.183414 |
| 690 | 0.006571 | 0.418403 | 0.501388 |
| 691 | 0.018275 | −0.11329 | −0.33405 |
| 692 | 0.005479 | −0.20021 | −0.56806 |
| 693 | 0.016065 | 0.07889 | 0.509461 |
| 694 | 0.035246 | 0.520546 | 0.908218 |
| 695 | −0.00993 | 0.096473 | 0.324842 |
| 696 | −0.04241 | −0.25184 | −0.46369 |
| 697 | 0.047459 | 0.387442 | 0.588406 |
| 698 | 0.031369 | 0.949367 | 0.779415 |
| 699 | 0.002836 | −0.136336 | −0.204499 |
| 700 | −0.003573 | 0.186663 | 0.111998 |
| 702 | −0.004795 | 0.43693 | 0.231795 |
| 703 | −0.06028 | −0.31369 | −1.02726 |
| 704 | 0.003621 | 0.319729 | 0.650712 |
| 705 | −0.01483 | −0.20685 | −0.21578 |
| 706 | 0.014229 | 0.22422 | 0.525072 |
| 707 | 0.001577 | −0.09783 | −0.40964 |
| 708 | −0.04664 | −0.34529 | −1.27109 |
| 710 | 0.00051 | −0.260385 | −0.325256 |
| 711 | 0.002346 | −0.21907 | −0.20731 |
| 712 | −0.02008 | −0.28454 | −0.83816 |
| 713 | 0.012303 | 0.317933 | 0.325442 |
| 714 | 0.002157 | −0.15149 | −0.20467 |
| 715 | −0.01341 | −0.28726 | −0.51249 |
| 716 | 0.017509 | 0.47379 | 0.696401 |
| 717 | 0.008381 | 0.181649 | 0.355226 |

TABLE 1a-continued phase reporter genes

| SEQ ID NO | log(ratio) CP | log(ratio) AP | log(ratio) BC |
|---|---|---|---|
| 718 | 0.043877 | 0.67105 | 1.03341 |
| 719 | 0.000274 | −0.20319 | −0.2538 |
| 720 | −0.02417 | −0.10504 | −0.96611 |
| 721 | 0.008385 | −0.16697 | −0.17811 |
| 723 | 0.003995 | 0.165978 | 0.337161 |
| 724 | 0.031318 | 0.262931 | 0.530697 |
| 725 | 0.002671 | −0.22388 | −0.24884 |
| 726 | −0.01741 | 0.97595 | 0.797231 |
| 727 | 0.026351 | 0.225521 | 0.513968 |
| 729 | 0.02065 | 0.165621 | 0.397537 |
| 730 | 0.007214 | −0.100867 | −0.390067 |
| 731 | −0.0053 | −0.24753 | −0.23765 |
| 732 | 0.016166 | −0.23723 | −0.26246 |
| 733 | −0.01548 | −0.23219 | −0.50029 |
| 734 | −0.02537 | −0.18612 | −0.57815 |
| 735 | 0.011289 | 0.626092 | 0.824474 |
| 736 | −0.03968 | 0.393852 | 0.572199 |
| 737 | −0.01477 | −0.37806 | −0.76952 |
| 738 | 0.014599 | −0.14944 | −0.15943 |
| 739 | 0.021606 | 0.4066 | 0.648213 |
| 740 | −0.02684 | −0.1602 | −0.6932 |
| 742 | −0.00331 | −0.21531 | −0.2852 |
| 743 | 0.041562 | 0.610125 | 0.714722 |
| 744 | 0.010195 | −0.23868 | −0.52272 |
| 746 | 0.007515 | 0.963717 | 0.90057 |
| 747 | 0.022799 | 0.047965 | 0.266429 |
| 748 | 0.01881 | 0.397986 | 0.472918 |
| 749 | 0.000816 | −0.18066 | −0.62683 |
| 750 | 0.011577 | −0.18089 | −0.26915 |
| 751 | 0.015959 | 0.23293 | 0.296034 |
| 752 | −0.00275 | −0.35468 | −0.25756 |
| 753 | −0.00158 | −0.31664 | −0.35017 |
| 754 | 0.014954 | 0.103777 | 0.342093 |
| 755 | −0.00071 | −0.19677 | −0.19549 |
| 756 | 0.01348 | 0.38543 | 0.649152 |
| 757 | −0.01417 | −0.20752 | −0.45013 |
| 758 | 0.005448 | 0.586497 | 0.766039 |
| 760 | −0.06324 | −0.39472 | −0.96545 |
| 761 | −0.04803 | −0.38169 | −0.82286 |
| 762 | 0.004229 | −0.13539 | −0.22993 |
| 763 | 0.020979 | −0.11787 | −0.47577 |
| 764 | −0.01408 | 0.306251 | 0.459896 |
| 765 | −0.00132 | −0.15961 | −0.17249 |
| 767 | −0.02884 | −0.17041 | −0.49641 |
| 769 | 0.000097 | −0.14405 | −0.31241 |
| 770 | −0.01516 | −0.36294 | −0.30147 |
| 771 | 0.01193 | 0.288731 | 0.577095 |
| 772 | 0.012468 | 0.132063 | 0.472429 |
| 773 | 0.036377 | 0.175691 | 0.421156 |
| 774 | 0.020938 | 0.292011 | 0.414609 |
| 775 | 0.001804 | 0.215251 | 0.408338 |
| 776 | −0.01539 | −0.23391 | −0.32651 |
| 777 | 0.008326 | −0.15574 | −0.15161 |
| 778 | 0.02172 | 0.179477 | 0.451299 |
| 779 | −0.0033 | 0.120409 | 0.642382 |
| 780 | 0.019732 | 0.33345 | 0.69041 |
| 781 | 0.049464 | 0.661373 | 0.621414 |
| 782 | 0.012342 | −0.18948 | −0.33074 |
| 783 | −0.0155 | −0.21106 | −0.27721 |
| 784 | 0.024083 | 0.273931 | 0.378123 |
| 786 | −0.00869 | 0.200554 | 0.342694 |
| 787 | −0.03945 | 0.040775 | −0.7592 |
| 789 | −0.011135 | 0.073025 | 0.220549 |
| 791 | −0.03637 | 0.959334 | 1.221178 |
| 792 | −0.02054 | −0.35395 | −0.60127 |
| 793 | −0.04991 | −0.27242 | −0.57387 |
| 794 | −0.00593 | −0.34796 | −0.3923 |
| 795 | −0.01029 | 0.258479 | 0.340795 |
| 797 | −0.04052 | −0.23779 | −0.61541 |
| 798 | 0.045775 | 0.403804 | 0.813492 |
| 799 | 0.008074 | −0.16841 | −0.31739 |
| 800 | −0.00706 | 0.240922 | 0.334387 |
| 801 | 0.016304 | 0.142557 | 0.409949 |
| 802 | 0.009912 | 0.062722 | 0.253013 |
| 803 | −0.00912 | −0.14396 | −0.21432 |
| 804 | 0.022445 | 0.368506 | 0.476569 |
| 805 | −0.04348 | −0.04699 | −0.73387 |
| 806 | 0.0422 | 0.403704 | 0.844882 |
| 807 | −0.00376 | 0.759829 | 0.986519 |
| 808 | −0.0061 | 0.414894 | 0.650949 |
| 810 | 0.025645 | 0.224121 | 0.479134 |
| 811 | −0.06415 | −0.26997 | −1.46272 |
| 812 | −0.04969 | −0.36744 | −1.10889 |
| 813 | 0.019976 | 0.437294 | 0.712531 |
| 814 | −0.00264 | 0.363777 | 0.646788 |
| 815 | −0.00046 | −0.19979 | −0.24987 |
| 816 | 0.009295 | 0.273522 | 0.491266 |
| 817 | 0.005098 | 0.332614 | 0.5022 |
| 818 | −0.02468 | −0.31556 | −0.42146 |
| 819 | −0.00973 | 0.35317 | 0.333512 |
| 820 | 0.013907 | 0.182063 | 0.366742 |
| 821 | 0.03667 | 0.176063 | 0.312605 |
| 822 | 0.016225 | −0.17943 | −0.28798 |
| 823 | −0.05108 | −0.24513 | −0.91963 |
| 824 | 0.00525 | −0.18863 | −0.23181 |
| 825 | 0.022476 | 0.314985 | 0.518725 |
| 826 | −0.00153 | 0.413111 | 0.565626 |
| 827 | 0.006651 | −0.26096 | −0.45155 |
| 828 | 0.011897 | 0.518342 | 0.800249 |
| 829 | −0.00438 | −0.15288 | −0.51254 |
| 830 | 0.001568 | −0.15148 | −0.55304 |
| 831 | −0.00465 | −0.15151 | −0.23487 |
| 832 | 0.008715 | −0.16021 | −0.2307 |
| 833 | 0.010857 | −0.27968 | −0.6406 |
| 834 | −0.00236 | 0.102748 | 0.4646 |
| 835 | 0.014748 | 0.238251 | 0.268061 |
| 836 | −0.01068 | 0.336503 | 0.498429 |
| 837 | −0.01263 | −0.1071 | −0.45097 |
| 838 | −0.01939 | −0.22991 | −0.52394 |
| 839 | −0.00016 | −0.09603 | −0.22419 |
| 842 | −0.0257 | 0.180238 | 0.534629 |
| 844 | 0.007381 | −0.22632 | −0.29685 |
| 846 | 0.026896 | −0.25572 | −0.44026 |
| 848 | −0.01661 | −0.39972 | −0.97718 |
| 849 | −0.01307 | −0.06095 | −0.44141 |
| 850 | 0.010372 | −0.02883 | −0.41223 |
| 851 | 0.010884 | 0.481556 | 0.677496 |
| 852 | −0.009777 | 0.061973 | 0.217413 |
| 853 | 0.005281 | −0.20109 | −0.26239 |
| 854 | −0.00896 | −0.14598 | −0.39826 |
| 855 | −0.02612 | −0.10349 | −0.34689 |
| 857 | −0.00174 | −0.01196 | −0.36949 |
| 858 | 0.035983 | 0.363392 | 0.460554 |
| 859 | −0.01618 | −0.19735 | −0.43419 |
| 860 | −0.02435 | −0.07585 | −0.53362 |
| 861 | 0.003144 | 0.327113 | 0.479729 |
| 862 | 0.003677 | 0.314081 | 0.570406 |
| 862 | 0.012512 | 0.101103 | 0.346959 |
| 863 | 0.007451 | 0.274864 | 0.258577 |
| 864 | −0.02988 | −0.30442 | −0.61003 |
| 865 | 0.027881 | 0.229076 | 0.453784 |
| 866 | 0.016554 | 0.334882 | 0.523243 |
| 867 | −0.00904 | −0.22622 | −0.35397 |
| 868 | −0.00683 | −0.14427 | −0.19388 |
| 869 | 0.007447 | 0.456183 | 0.578913 |
| 870 | 0.014298 | −0.1555 | −0.37831 |
| 871 | −0.01855 | −0.376 | −0.72345 |
| 872 | −0.02113 | −0.05347 | −0.524 |
| 874 | −0.10276 | −0.17356 | −0.64791 |
| 875 | 0.050631 | 0.371567 | 0.583242 |
| 876 | 0.006277 | −0.17522 | −0.18162 |
| 877 | 0.026906 | −0.16371 | −0.22232 |
| 878 | 0.0311 | 0.498037 | 0.731472 |
| 879 | −0.06188 | −0.17245 | −0.70482 |
| 881 | −0.00317 | 0.251998 | 0.473131 |
| 882 | 0.013799 | 0.184541 | 0.477454 |
| 883 | 0.003912 | −0.20012 | −0.22764 |
| 885 | 0.007449 | −0.15174 | −0.48211 |
| 886 | 0.028321 | 0.195759 | 0.414775 |
| 887 | −0.02561 | −0.25312 | −0.78514 |

TABLE 1a-continued phase reporter genes

| SEQ ID NO | log(ratio) CP | log(ratio) AP | log(ratio) BC |
|---|---|---|---|
| 888 | 0.020667 | 0.101094 | 0.279132 |
| 889 | 0.039251 | 0.834583 | 1.008713 |
| 890 | −0.01837 | −0.1427 | −0.38115 |
| 891 | 0.000975 | 0.288875 | 0.775853 |
| 892 | 0.044388 | 0.442743 | 0.639431 |
| 893 | 0.034174 | 0.663734 | 0.752687 |
| 895 | −0.0313 | −0.22239 | −0.4595 |
| 896 | 0.001995 | 0.321556 | 0.387578 |
| 897 | 0.002044 | 0.234951 | 0.349403 |
| 898 | 0.038121 | 0.442656 | 0.54463 |
| 899 | 0.005928 | 0.12006 | 0.254396 |
| 901 | 0.036664 | −0.30177 | −0.35545 |
| 902 | 0.011175 | 0.371103 | 0.614696 |
| 903 | 0.016207 | 0.619633 | 0.917977 |
| 904 | 0.003998 | 0.168421 | 0.202759 |
| 905 | −0.08003 | −0.36991 | −0.74714 |
| 906 | 0.009153 | 0.106628 | 0.432846 |
| 907 | −0.00466 | 0.600655 | 0.532454 |
| 909 | −0.0164 | −0.38781 | −0.33255 |
| 910 | 0.011684 | −0.28883 | −0.44642 |
| 911 | −0.03579 | 0.549078 | 0.508632 |
| 912 | −0.04968 | −0.34888 | −0.82801 |
| 913 | −0.00198 | −0.17084 | −0.1983 |
| 914 | 0.040661 | 0.390545 | 0.499157 |
| 916 | 0.02418 | 1.176181 | 0.793972 |
| 918 | 0.039866 | 0.281655 | 0.578945 |
| 919 | 0.021558 | 0.618284 | 0.670695 |
| 920 | −0.00183 | 0.109512 | 0.304021 |
| 921 | 0.051782 | 0.41822 | 0.704089 |
| 922 | −0.00581 | −0.29828 | −0.28228 |
| 923 | −0.07327 | −0.1579 | −0.89248 |
| 925 | 0.019041 | 0.365025 | 0.862874 |
| 926 | 0.027457 | 0.215297 | 0.366148 |
| 927 | 0.003369 | 0.110352 | 0.504786 |
| 928 | 0.000941 | −0.16168 | −0.17619 |
| 929 | −0.01183 | −0.17313 | −0.25897 |
| 930 | −0.04618 | −0.24458 | −0.82088 |
| 931 | 0.017421 | 0.728606 | 0.679256 |
| 932 | 0.003436 | −0.16538 | −0.15426 |
| 933 | −0.02288 | −0.07943 | −0.60235 |
| 934 | −0.001515 | 0.49437 | 0.349162 |
| 935 | 0.043192 | 0.155467 | 0.415401 |
| 936 | −0.01332 | 0.239028 | 0.430634 |
| 937 | 0.006872 | −0.15327 | −0.17586 |
| 938 | 0.005084 | −0.09074 | −0.32085 |
| 939 | 0.014272 | 0.179576 | 0.438968 |
| 940 | −0.03475 | −0.29724 | −0.57118 |
| 941 | 0.020524 | 0.332454 | 0.684849 |
| 942 | 0.031481 | 0.306397 | 0.438196 |
| 943 | 0.015666 | 0.301135 | 0.654813 |
| 944 | −0.00517 | −0.32082 | −0.24601 |
| 945 | 0.017104 | 0.283783 | 0.606805 |
| 946 | 0.021571 | 0.245372 | 0.49649 |
| 947 | 0.02834 | 0.434194 | 0.686041 |
| 948 | −0.04565 | −0.14863 | −0.46035 |
| 949 | 0.002425 | −0.27508 | −0.5014 |
| 950 | −0.01103 | −0.35658 | −0.30875 |
| 951 | 0.017244 | 0.572619 | 0.667183 |
| 952 | −0.04401 | −0.3078 | −1.2935 |
| 953 | 0.021905 | −0.21672 | −0.18373 |
| 954 | 0.014326 | 0.307343 | 0.497944 |
| 955 | −0.01014 | −0.28982 | −0.28704 |
| 956 | −0.04652 | −0.28568 | −0.64755 |
| 957 | −0.00599 | 0.009669 | 0.356692 |
| 958 | −0.00138 | 0.13155 | 0.339588 |
| 959 | −0.05625 | −0.17665 | −0.57717 |
| 961 | −0.02031 | −0.16875 | −0.39111 |
| 963 | −0.02444 | 0.160998 | 0.526601 |
| 964 | 0.021577 | 0.114327 | 0.361967 |
| 965 | 0.010129 | 0.184328 | 0.355173 |
| 966 | 0.043447 | 0.476225 | 0.80095 |
| 967 | 0.011853 | 0.380202 | 0.54573 |
| 968 | −0.02322 | −0.29491 | −0.39674 |
| 969 | 0.005774 | −0.20359 | −0.31987 |
| 970 | −0.03669 | 0.020952 | −0.78504 |
| 971 | 0.072152 | 0.439944 | 0.970133 |
| 972 | 0.007861 | −0.16402 | −0.2072 |
| 974 | 0.022986 | 0.191353 | 0.366881 |
| 975 | 0.031431 | 0.309987 | 0.621938 |
| 976 | 0.011977 | −0.20413 | −0.18017 |
| 978 | 0.03035 | −0.08794 | −0.26132 |
| 979 | 0.024046 | 0.380012 | 0.527625 |
| 981 | −0.02969 | −0.39102 | −0.64658 |
| 982 | 0.04254 | 0.265078 | 0.600318 |
| 983 | −0.009189 | −0.179037 | −0.279808 |
| 984 | −0.09009 | −0.15535 | −1.52231 |
| 985 | −0.01148 | −0.18115 | −0.30972 |
| 986 | −0.00499 | −0.24362 | −0.38006 |
| 987 | −0.00309 | −0.16729 | −0.18861 |
| 988 | −0.00048 | −0.20341 | −0.21982 |
| 989 | 0.03261 | 0.298725 | 0.600147 |
| 990 | 0.006807 | 0.312897 | 0.452625 |
| 991 | −0.04519 | −0.23 | −0.67622 |
| 992 | −0.02925 | −0.26477 | −0.67592 |
| 993 | −0.00823 | −0.07657 | −0.55087 |
| 994 | 0.007742 | −0.18516 | −0.37268 |
| 995 | 0.018282 | 0.135455 | 0.283378 |
| 996 | −0.0016 | −0.17755 | −0.22021 |
| 997 | 0.005116 | 0.321096 | 0.318855 |
| 998 | 0.014517 | −0.20872 | −0.18841 |
| 999 | 0.008411 | −0.25078 | −0.17848 |
| 1001 | 0.014114 | 0.279841 | 0.487074 |
| 1002 | 0.006213 | −0.20625 | −0.19138 |
| 1003 | −0.01909 | −0.06829 | −0.60082 |
| 1004 | 0.000404 | 0.681658 | 0.763917 |
| 1005 | −0.004206 | 0.264613 | 0.406912 |
| 1006 | −0.02649 | −0.15549 | −1.28121 |
| 1007 | −0.00117 | 0.408447 | 0.584952 |
| 1009 | −0.05018 | −0.36597 | −0.48778 |
| 1010 | −0.00053 | 0.25552 | 0.553625 |
| 1011 | −0.02185 | −0.15114 | −0.33877 |
| 1013 | 0.010628 | −0.19019 | −0.19031 |
| 1014 | −0.027032 | 0.218431 | 0.369874 |
| 1015 | 0.018676 | 0.279977 | 0.411238 |
| 1016 | −0.03486 | −0.21403 | −0.66175 |
| 1017 | −0.00635 | −0.1185 | −0.26901 |
| 1018 | −0.1021 | −0.35522 | −0.92878 |
| 1019 | −0.0324 | −0.05782 | −0.43452 |
| 1020 | −0.00402 | 0.352591 | 0.589409 |
| 1021 | −0.02319 | −0.24806 | −0.2361 |
| 1022 | −0.00207 | 0.230491 | 0.495073 |
| 1024 | −0.11797 | −0.46245 | −1.002 |
| 1025 | −0.01431 | 0.336562 | 0.382849 |
| 1026 | 0.018603 | 0.220777 | 0.327328 |
| 1027 | −0.11023 | 0.028131 | −0.64983 |
| 1028 | −0.04121 | −0.34023 | −1.16376 |
| 1029 | 0.000038 | 0.073128 | 0.356822 |
| 1030 | 0.011849 | −0.24586 | −0.35103 |
| 1031 | 0.016593 | −0.15782 | −0.20249 |
| 1032 | 0.033009 | 0.202937 | 0.396809 |
| 1033 | 0.000399 | 0.349191 | 0.411658 |
| 1034 | −0.01282 | −0.19304 | −0.69736 |
| 1035 | −0.04048 | −0.28852 | −0.58426 |
| 1036 | 0.018457 | 0.150121 | 0.282032 |
| 1039 | −0.00901 | −0.22817 | −0.28791 |
| 1040 | −0.02948 | −0.28206 | −0.28126 |
| 1041 | −0.00327 | −0.10615 | −0.38234 |
| 1042 | 0.030321 | 0.19916 | 0.308977 |
| 1043 | −0.03145 | −0.24414 | −0.97419 |
| 1044 | 0.019575 | 0.062365 | 0.388156 |
| 1045 | 0.010258 | 0.173701 | 0.331831 |
| 1046 | −0.0251 | 0.149857 | 0.333223 |
| 1047 | −0.00375 | 0.250117 | 0.454552 |
| 1048 | 0.034981 | 0.249228 | 0.487558 |
| 1049 | −0.04425 | −0.33632 | −0.8063 |
| 1050 | −0.00768 | −0.17663 | −0.34345 |
| 1053 | 0.06261 | 0.78143 | 0.868418 |
| 1055 | 0.019469 | 0.178076 | 0.524438 |
| 1056 | −0.06308 | −0.26881 | −0.4172 |
| 1057 | 0.006551 | −0.42887 | −0.53874 |

TABLE 1a-continued phase reporter genes

| SEQ ID NO | log(ratio) CP | log(ratio) AP | log(ratio) BC |
|---|---|---|---|
| 1058 | 0.023535 | 0.50037 | 0.599716 |
| 1060 | 0.004592 | 0.380719 | 0.656335 |
| 1061 | 0.021965 | 0.208796 | 0.523574 |
| 1062 | 0.025067 | 0.357962 | 0.531818 |
| 1063 | −0.00834 | 0.563554 | 0.859166 |
| 1064 | 0.012427 | 0.355733 | 0.553985 |
| 1065 | 0.017377 | 0.357365 | 0.562849 |
| 1066 | 0.007302 | 0.434951 | 0.812628 |
| 1068 | 0.017637 | 0.401677 | 0.425526 |
| 1069 | −0.02752 | −0.31181 | −0.91688 |
| 1070 | −0.02093 | −0.18417 | −0.36302 |
| 1071 | −0.00263 | −0.14252 | −0.27997 |
| 1072 | −0.05215 | −0.06966 | −1.07666 |
| 1073 | −0.02875 | −0.12441 | −0.6644 |
| 1074 | 0.004721 | −0.03479 | −0.33264 |
| 1075 | 0.012818 | 0.100504 | 0.293213 |
| 1076 | −0.04766 | 0.580887 | 0.667447 |
| 1077 | −0.01309 | −0.17865 | −0.24161 |
| 1078 | 0.011927 | 0.065431 | 0.305479 |
| 1079 | 0.016793 | 0.510837 | 0.670804 |
| 1080 | 0.024405 | 0.341992 | 0.629413 |
| 1081 | −0.00395 | −0.03511 | −0.41353 |
| 1082 | −0.02 | 0.311805 | 0.357334 |
| 1083 | 0.017146 | 0.225344 | 0.441432 |
| 1084 | 0.024464 | 0.131899 | 0.303004 |
| 1085 | 0.02197 | 0.416374 | 0.734145 |
| 1086 | 0.01073 | 0.112916 | 0.453848 |
| 1087 | −0.01838 | −0.15669 | −0.54498 |
| 1088 | 0.018314 | 0.547187 | 0.460808 |
| 1089 | −0.056921 | 0.265345 | 0.488138 |
| 1090 | 0.023626 | 0.085768 | 0.549737 |
| 1091 | 0.010388 | 0.278295 | 0.449669 |
| 1092 | 0.031164 | 0.741399 | 0.650443 |
| 1093 | 0.029009 | 0.366946 | 0.350824 |
| 1094 | −0.05785 | 0.068234 | 0.383789 |
| 1096 | 0.005542 | −0.21656 | −0.26778 |
| 1097 | 0.000693 | 1.027183 | 0.817624 |
| 1098 | 0.003462 | 0.570549 | 0.636175 |
| 1099 | 0.03764 | 0.154319 | 0.321177 |
| 1100 | −0.026376 | −0.107488 | 0.120579 |
| 1101 | 0.012177 | −0.14239 | −0.17908 |
| 1102 | 0.025067 | 0.290726 | 0.474701 |
| 1103 | 0.002098 | 0.572434 | 0.496989 |
| 1104 | −0.03808 | 0.578197 | 0.60757 |
| 1105 | 0.035517 | 1.347917 | 0.843268 |
| 1106 | 0.013275 | 0.053145 | 0.284804 |
| 1107 | −0.03182 | 0.059138 | −0.61486 |
| 1108 | −0.02981 | −0.17465 | −0.93003 |
| 1109 | 0.016606 | 0.230911 | 0.315637 |
| 1110 | 0.033077 | 0.270656 | 0.444209 |
| 1111 | 0.016624 | 0.31607 | 0.56831 |
| 1113 | 0.011372 | −0.22076 | −0.18823 |
| 1114 | −0.01167 | −0.16839 | −0.56389 |
| 1115 | 0.025286 | 0.33227 | 0.592999 |
| 1116 | 0.008912 | 0.044417 | 0.255518 |
| 1117 | −0.03308 | 0.316885 | 0.45063 |
| 1118 | −0.07635 | −0.42718 | −1.179 |
| 1119 | −0.00971 | −0.20014 | −0.44261 |
| 1120 | −0.0004 | −0.09832 | −0.24581 |
| 1121 | −0.02783 | 0.01481 | −0.52065 |
| 1122 | 0.034977 | 0.903676 | 0.752922 |
| 1123 | −0.03938 | −0.12671 | −0.89578 |
| 1125 | −0.03756 | −0.25992 | −0.32128 |
| 1126 | −0.02263 | 0.438001 | 0.541005 |
| 1127 | −0.02351 | −0.21881 | −0.33782 |
| 1128 | −0.04253 | 0.370419 | 0.511782 |
| 1129 | 0.015241 | 0.427515 | 0.729106 |
| 1130 | 0.0166 | 0.32108 | 0.479725 |
| 1131 | −0.01176 | −0.25284 | −0.61788 |
| 1133 | −0.03665 | −0.32606 | −0.98901 |
| 1134 | 0.006542 | 0.335645 | 0.417338 |
| 1135 | −0.01257 | −0.26131 | −0.43166 |
| 1136 | −0.00908 | −0.04902 | −0.42429 |
| 1137 | −0.03391 | −0.14525 | −0.4193 |
| 1139 | 0.002503 | 0.212291 | 0.326949 |
| 1141 | 0.02655 | 0.411572 | 0.487524 |
| 1142 | 0.018869 | −0.08067 | −0.33102 |
| 1144 | 0.000881 | 0.20446 | 0.356194 |
| 1145 | −0.003373 | −0.121256 | −0.288823 |
| 1146 | 0.012057 | 0.503047 | 0.766832 |
| 1147 | 0.017324 | −0.15498 | −0.12866 |
| 1148 | 0.014654 | 0.580163 | 0.569959 |
| 1149 | 0.00596 | 0.226372 | 0.532382 |
| 1150 | 0.014193 | 0.400376 | 0.602591 |
| 1151 | −0.04481 | −0.36921 | −0.59346 |
| 1152 | 0.002655 | 0.213823 | 0.31625 |
| 1153 | −0.00094 | 0.638368 | 0.973322 |
| 1154 | −0.03225 | −0.28277 | −0.45494 |
| 1155 | −0.0166 | 0.198975 | 0.33185 |
| 1156 | 0.015301 | 0.242337 | 0.419749 |
| 1159 | 0.027506 | 0.353794 | 0.651315 |
| 1161 | −0.036419 | −0.112814 | −0.289979 |
| 1162 | −0.01107 | −0.20437 | −0.25257 |
| 1163 | 0.019138 | 0.232556 | 0.315603 |
| 1164 | 0.006938 | 0.293818 | 0.328692 |
| 1166 | 0.006071 | −0.17796 | −0.25646 |
| 1167 | −0.01523 | 0.366307 | 0.569853 |
| 1168 | 0.025043 | 0.135794 | 0.329976 |
| 1169 | 0.009461 | −0.11973 | −0.2202 |
| 1171 | 0.002263 | 0.122244 | 0.296596 |
| 1172 | 0.009329 | 0.253737 | 0.417233 |
| 1174 | 0.040878 | 0.678648 | 0.878169 |
| 1175 | 0.015155 | 0.363392 | 0.530247 |
| 1176 | 0.008189 | 0.19667 | 0.216307 |
| 1177 | 0.01844 | −0.06651 | −0.18047 |
| 1178 | 0.006144 | 0.360987 | 0.473891 |
| 1179 | 0.008132 | −0.18457 | −0.26672 |
| 1180 | −0.003015 | 0.149485 | 0.243152 |
| 1181 | 0.012396 | 0.380719 | 0.560324 |
| 1182 | 0.024593 | 0.385965 | −0.45446 |
| 1184 | −0.00575 | −0.18627 | −0.14456 |
| 1185 | 0.017383 | −0.19347 | −0.4348 |
| 1186 | 0.012756 | 0.206434 | 0.428343 |
| 1187 | −0.01855 | −0.24637 | −0.27999 |
| 1189 | −0.02801 | −0.19253 | −0.50674 |
| 1191 | −0.05399 | −0.00446 | −0.77119 |
| 1192 | 0.021475 | 0.286349 | 0.459673 |
| 1193 | 0.005136 | −0.2011 | −0.28828 |
| 1194 | −0.01826 | −0.21315 | −0.49365 |
| 1195 | 0.010377 | 0.49889 | 0.629694 |
| 1196 | 0.01497 | −0.12611 | −0.23818 |
| 1198 | 0.010758 | −0.09252 | −0.77659 |
| 1199 | −0.02105 | 1.121281 | 0.793462 |
| 1200 | 0.012658 | −0.11724 | −0.14672 |
| 1201 | −0.08507 | −0.26107 | −0.91786 |
| 1203 | −0.00142 | −0.12588 | −0.38474 |
| 1204 | −0.03462 | −0.12201 | −0.86282 |
| 1205 | −0.01014 | 0.21371 | 0.382011 |
| 1206 | 0.009131 | 0.218745 | 0.424028 |
| 1207 | 0.004704 | −0.01245 | 0.593833 |
| 1208 | 0.02432 | 0.320849 | 0.402321 |
| 1209 | 0.016472 | 0.442769 | 0.432454 |
| 1210 | 0.052941 | 0.394456 | 0.657637 |
| 1211 | 0.003305 | 0.318015 | 0.654003 |
| 1212 | 0.011172 | 0.357095 | 0.588772 |
| 1213 | 0.019949 | 0.201369 | 0.50271 |
| 1214 | 0.018047 | 0.354227 | 0.654053 |
| 1216 | −0.00689 | −0.18258 | −0.18832 |
| 1217 | 0.019884 | 0.403171 | 0.569088 |
| 1218 | 0.004345 | −0.222 | −0.58305 |
| 1220 | 0.043171 | 0.743122 | 0.818423 |
| 1221 | −0.01673 | −0.29039 | −0.91411 |
| 1222 | 0.017848 | 0.299427 | 0.402236 |
| 1225 | −0.00581 | 0.024124 | 0.281781 |
| 1226 | 0.022046 | −0.13504 | −0.2592 |
| 1227 | −0.00376 | −0.2512 | −0.32098 |
| 1228 | −0.00739 | −0.2564 | −0.33308 |
| 1229 | −0.01839 | 0.511272 | 0.717946 |
| 1230 | −0.00711 | 0.305514 | 0.533051 |
| 1231 | 0.037469 | 0.613447 | 0.566359 |

TABLE 1a-continued phase reporter genes

| SEQ ID NO | log(ratio) CP | log(ratio) AP | log(ratio) BC |
|---|---|---|---|
| 1232 | 0.009666 | 0.136401 | 0.26644 |
| 1233 | −0.00655 | 0.503464 | 0.563589 |
| 1234 | 0.003295 | −0.168464 | −0.233929 |
| 1235 | −0.01657 | −0.23722 | −0.44696 |
| 1236 | 0.003271 | 0.298949 | 0.539399 |
| 1237 | 0.025843 | 0.113891 | 0.527452 |
| 1238 | −0.00358 | 0.926368 | 0.758591 |
| 1239 | −0.01405 | 0.382283 | 0.758699 |
| 1240 | −0.00226 | −0.18271 | −0.25626 |
| 1241 | −0.02257 | −0.30133 | −0.85533 |
| 1242 | 0.012898 | 0.195708 | 0.352289 |
| 1243 | 0.004795 | −0.20695 | −0.3829 |
| 1244 | −0.05349 | 0.453419 | 0.508643 |
| 1245 | −0.06682 | −0.191 | −0.77392 |
| 1246 | 0.029524 | 0.196978 | 0.462647 |
| 1248 | 0.034158 | 0.353652 | 0.502564 |
| 1250 | 0.029249 | 0.339036 | 0.452083 |
| 1251 | 0.003557 | −0.23636 | −0.4367 |
| 1252 | 0.010304 | −0.10733 | −0.11873 |
| 1253 | −0.00495 | −0.24998 | −0.23134 |
| 1255 | 0.034283 | 0.359501 | 0.453378 |
| 1256 | 0.029414 | 0.54019 | 0.722006 |
| 1257 | −0.01321 | 0.597674 | 0.677903 |
| 1258 | −0.02966 | −0.28207 | −0.3473 |
| 1259 | 0.037858 | 0.631398 | 0.880664 |
| 1260 | 0.012479 | 0.15826 | 0.251938 |
| 1261 | −0.04607 | −0.35607 | −0.87523 |
| 1262 | 0.032108 | 0.400689 | 0.740311 |
| 1263 | 0.026003 | 0.171905 | 0.304026 |
| 1264 | −0.00432 | −0.14192 | −0.28998 |
| 1265 | 0.045358 | 0.265558 | 0.421429 |
| 1266 | 0.004985 | −0.24648 | −0.45586 |
| 1268 | 0.019584 | −0.17999 | −0.18744 |
| 1269 | 0.01464 | 0.199696 | 0.375417 |
| 1270 | −0.04419 | −0.09453 | −0.90111 |
| 1271 | −0.0335 | −0.24235 | −0.41048 |
| 1272 | 0.022658 | 0.215962 | 0.336837 |
| 1273 | 0.013657 | 0.322077 | 0.361842 |
| 1274 | −0.00528 | 0.452985 | 0.484143 |
| 1275 | 0.027095 | 0.125192 | 0.309546 |
| 1276 | 0.022706 | 0.34597 | 0.56867 |
| 1277 | 0.057221 | 0.228746 | 0.522404 |
| 1278 | 0.022288 | 0.216696 | 0.404358 |
| 1279 | 0.011503 | 0.221481 | 0.295567 |
| 1280 | 0.026446 | 0.314327 | 0.446594 |
| 1281 | −0.02678 | −0.28869 | −0.43194 |
| 1282 | −0.03664 | −0.23212 | −0.5352 |
| 1283 | 0.004279 | 0.291887 | 0.377161 |
| 1284 | 0.000588 | 0.130553 | 0.428864 |
| 1285 | −0.06086 | −0.27789 | −0.97813 |
| 1286 | −0.01709 | −0.07024 | −0.46401 |
| 1287 | −0.09316 | −0.29114 | −1.16849 |
| 1288 | −0.025178 | 0.393585 | 0.566352 |
| 1289 | −0.00701 | 0.159181 | 0.499263 |
| 1290 | 0.019582 | 0.353449 | 0.489098 |
| 1291 | 0.033449 | 0.334295 | 0.543183 |
| 1292 | 0.017764 | 0.576765 | 0.82581 |
| 1293 | −0.00263 | −0.32052 | −0.79431 |
| 1294 | 0.013573 | 0.445178 | 0.588026 |
| 1295 | 0.009377 | 0.323522 | 0.473998 |
| 1296 | 0.011137 | 0.587371 | 0.66752 |
| 1297 | −0.04222 | −0.11578 | −0.59989 |
| 1298 | −0.01041 | −0.17175 | −0.34998 |
| 1299 | 0.005281 | 0.743311 | 0.741194 |
| 1301 | −0.00538 | 0.235471 | 0.388888 |
| 1302 | 0.020169 | 0.119638 | 0.351079 |
| 1303 | −0.02888 | −0.11932 | −0.48525 |
| 1304 | 0.020814 | 0.199539 | 0.677553 |
| 1305 | 0.008689 | 0.343536 | 0.406994 |
| 1307 | 0.007356 | 0.428407 | 0.46605 |
| 1308 | −0.051939 | −0.225136 | −1.142094 |
| 1309 | 0.005395 | 0.342172 | 0.443033 |
| 1310 | 0.000316 | 0.518569 | 0.585238 |
| 1312 | −0.01431 | −0.18005 | −0.49837 |
| 1313 | 0.030494 | 0.167402 | 0.472945 |
| 1314 | 0.020166 | 0.313346 | 0.414523 |
| 1315 | 0.054748 | 0.451925 | 0.830386 |
| 1316 | 0.004613 | 0.292623 | 0.388577 |
| 1317 | 0.0091 | 0.020812 | 0.340786 |
| 1318 | 0.014614 | 0.402444 | 0.503144 |
| 1319 | 0.02863 | 0.474709 | 0.738852 |
| 1320 | 0.030476 | 0.756053 | 0.982615 |
| 1321 | 0.001629 | −0.29821 | −0.29855 |
| 1322 | 0.005325 | −0.2292 | −0.42313 |
| 1324 | −0.00526 | 0.36423 | 0.424376 |
| 1326 | 0.03331 | 0.194719 | 0.42578 |
| 1327 | 0.0232 | 0.29162 | 0.330751 |
| 1328 | 0.016117 | −0.125314 | −0.193334 |
| 1330 | 0.016789 | 0.182636 | 0.346491 |
| 1332 | 0.005976 | 0.254564 | 0.356874 |
| 1333 | −0.00504 | 0.768339 | 1.002621 |
| 1334 | −0.003194 | 0.078374 | −0.585411 |
| 1335 | 0.000835 | 0.222968 | 0.342347 |
| 1337 | 0.00182 | −0.19066 | −0.23499 |
| 1338 | 0.032385 | 0.161068 | 0.477244 |
| 1339 | 0.014618 | 0.751356 | 0.944542 |
| 1340 | 0.032122 | 0.466901 | 0.648576 |
| 1341 | 0.021917 | 0.208059 | 0.307776 |
| 1342 | 0.018734 | 0.542354 | 0.822406 |
| 1343 | −0.00563 | −0.19206 | −0.23528 |
| 1344 | 0.018621 | 0.292752 | 0.269113 |
| 1345 | 0.010144 | 0.33047 | 0.61251 |
| 1346 | −0.02857 | −0.28307 | −1.03438 |
| 1347 | 0.03026 | 0.367945 | 0.528372 |
| 1348 | 0.015011 | 0.192641 | 0.50174 |
| 1349 | −0.00353 | −0.14764 | −0.20337 |
| 1350 | 0.032319 | 0.014209 | 0.5108 |
| 1351 | 0.018354 | 0.380567 | 0.593633 |
| 1352 | −0.013243 | −0.259131 | −0.724495 |
| 1353 | 0.035392 | −0.05243 | −0.37738 |
| 1354 | −0.02446 | −0.22995 | −0.65922 |
| 1355 | −0.01664 | −0.19935 | −0.27468 |
| 1356 | −0.03214 | −0.02532 | −0.81287 |
| 1357 | 0.008521 | −0.34216 | −0.42733 |
| 1358 | 0.015462 | 0.27866 | 0.645272 |
| 1359 | 0.023989 | 0.121833 | 0.383513 |
| 1360 | 0.010781 | −0.18127 | −0.1529 |
| 1361 | 0.026042 | 0.353157 | 0.623054 |
| 1362 | 0.003863 | −0.23455 | −0.3301 |
| 1363 | −0.03543 | −0.25903 | −1.16737 |
| 1364 | −0.00654 | −0.19963 | −0.60403 |
| 1365 | −0.02165 | −0.12628 | −0.33238 |
| 1366 | 0.013687 | −0.15116 | −0.23455 |
| 1368 | −0.01815 | −0.18952 | −0.69139 |
| 1369 | −0.06013 | 0.032736 | −0.94651 |
| 1370 | 0.028047 | 0.280669 | 0.48633 |
| 1371 | 0.009233 | 0.256992 | 0.401849 |
| 1372 | −0.00438 | −0.25873 | −0.58339 |
| 1373 | 0.020313 | 0.609572 | 0.912538 |
| 1374 | 0.00521 | −0.18885 | −0.27245 |
| 1375 | 0.003456 | −0.07589 | −0.47191 |
| 1376 | 0.025257 | 0.336702 | 0.34242 |
| 1377 | 0.044933 | 0.368729 | 0.374334 |
| 1378 | 0.015994 | 0.220107 | 0.56257 |
| 1380 | 0.019559 | −0.18793 | −0.24357 |
| 1381 | 0.01507 | 0.738692 | 0.695833 |
| 1382 | −0.00849 | −0.1489 | −0.24162 |
| 1383 | −0.04272 | −0.27617 | −0.99765 |
| 1384 | −0.03381 | −0.33113 | −0.89608 |
| 1385 | −0.06548 | −0.40109 | −1.30647 |
| 1386 | −0.00609 | 0.146801 | 0.479846 |
| 1387 | 0.013637 | 0.128414 | 0.56211 |
| 1388 | 0.017622 | 0.029003 | 0.286134 |
| 1390 | 0.004508 | 0.372977 | 0.672647 |
| 1391 | 0.003613 | −0.23198 | −0.31486 |
| 1392 | 0.017767 | 0.271895 | 0.432571 |
| 1393 | 0.033174 | 0.633348 | 0.853292 |
| 1394 | −0.02221 | 0.621003 | 0.793644 |
| 1395 | 0.000157 | 0.518813 | 0.550443 |
| 1396 | −0.00861 | 0.213281 | 0.422907 |

TABLE 1a-continued phase reporter genes

| SEQ ID NO | log(ratio) CP | log(ratio) AP | log(ratio) BC |
|---|---|---|---|
| 1397 | 0.014266 | 0.163962 | 0.196485 |
| 1398 | 0.021745 | 0.452557 | 0.530416 |
| 1399 | −0.00101 | 0.262192 | 0.667307 |
| 1400 | −0.034692 | −0.392913 | −0.855372 |
| 1401 | −0.03828 | 0.451175 | 0.685084 |
| 1402 | −0.09483 | −0.42459 | −1.16257 |
| 1403 | 0.016989 | 0.479743 | 0.634946 |
| 1404 | −0.03076 | −0.18561 | −0.75358 |
| 1405 | 0.013286 | 0.313671 | 0.4916 |
| 1406 | 0.015457 | 0.234071 | 0.375441 |
| 1407 | −0.00814 | −0.17416 | −0.63102 |
| 1408 | −0.02704 | −0.28184 | −0.99231 |
| 1412 | 0.024252 | 0.224321 | 0.519718 |
| 1413 | −0.04924 | −0.18212 | −0.47862 |
| 1414 | 0.015923 | 0.45682 | 0.584422 |
| 1417 | 0.006998 | 0.487101 | 0.537885 |
| 1418 | −0.0141 | −0.27303 | −0.25922 |
| 1419 | −0.01389 | −0.31268 | −0.49868 |
| 1420 | −0.01003 | −0.08542 | −0.52478 |
| 1421 | −0.03398 | −0.29302 | −1.51294 |
| 1422 | 0.017588 | 0.342359 | 0.583056 |
| 1423 | 0.014237 | −0.10384 | −0.46907 |
| 1424 | 0.00831 | 0.139954 | 0.485632 |
| 1425 | 0.01932 | 0.28438 | 0.385448 |
| 1426 | −0.12693 | −0.40622 | −1.13742 |
| 1427 | −0.00458 | 0.123441 | 0.438635 |
| 1428 | −0.01252 | −0.30184 | −0.49421 |
| 1429 | −0.00899 | 0.061733 | 0.421074 |
| 1430 | 0.031913 | 0.441498 | 0.763228 |
| 1431 | −0.02015 | 0.316071 | 0.317873 |
| 1432 | −0.00569 | −0.28524 | −0.2166 |
| 1433 | −0.0028 | −0.0174 | −0.5584 |
| 1434 | 0.012835 | 0.079422 | 0.405638 |
| 1436 | 0.00776 | 0.141442 | 0.475229 |
| 1437 | 0.015311 | 0.379826 | 0.482844 |
| 1438 | −0.0554 | −0.17035 | −0.66334 |
| 1439 | 0.027906 | 0.365461 | 0.347987 |
| 1441 | −0.01263 | −0.13879 | −0.3376 |
| 1442 | −0.02466 | 0.005115 | −0.54418 |
| 1443 | 0.024948 | 0.150195 | 0.418992 |
| 1444 | 0.004366 | 0.653399 | 0.595964 |
| 1445 | −0.02 | −0.18717 | −0.38574 |
| 1447 | 0.012592 | 0.148241 | 0.327586 |
| 1448 | −0.00061 | 0.184486 | 0.315187 |
| 1450 | 0.011963 | 0.380594 | 0.485261 |
| 1451 | 0.000431 | 0.345694 | 0.425181 |
| 1453 | −0.00975 | −0.2067 | −0.3633 |
| 1454 | −0.01498 | 0.145203 | 0.362109 |
| 1455 | 0.033546 | 0.246096 | 0.413418 |
| 1457 | 0.001452 | 0.806469 | 0.880049 |
| 1458 | 0.002333 | 0.364429 | 0.573835 |
| 1459 | 0.006921 | 0.199719 | 0.269475 |
| 1460 | 0.015669 | 0.4089 | 0.477517 |
| 1461 | 0.022091 | 0.819277 | 0.777643 |
| 1462 | −0.00351 | 0.305503 | 0.426973 |
| 1463 | −0.02995 | −0.25237 | −0.47916 |
| 1465 | −0.0279 | 0.600183 | 0.510733 |
| 1466 | −0.01195 | 0.250378 | 0.379188 |
| 1467 | −0.0752 | −0.22959 | −0.95248 |
| 1468 | −0.05201 | −0.24888 | −0.91563 |
| 1469 | −0.01809 | −0.24602 | −0.26632 |
| 1470 | 0.010716 | 0.221732 | 0.572832 |
| 1471 | −0.02516 | 0.256886 | 0.566675 |
| 1473 | 0.00739 | 0.720957 | 0.653903 |
| 1474 | −0.01891 | −0.35534 | −0.69965 |
| 1475 | 0.006673 | −0.26152 | −0.47431 |
| 1476 | −0.06571 | −0.13156 | −0.75062 |
| 1477 | 0.025057 | 0.252585 | 0.415632 |
| 1479 | 0.002265 | 0.095633 | 0.361984 |
| 1480 | −0.00258 | −0.31055 | −0.72759 |
| 1481 | 0.000807 | 0.16679 | 0.376415 |
| 1483 | −0.02429 | −0.27549 | −0.4121 |
| 1484 | 0.00948 | 0.22098 | 0.587438 |
| 1485 | 0.031423 | 0.161323 | 0.372897 |
| 1486 | 0.025527 | 0.503757 | 0.600076 |
| 1487 | −0.02211 | −0.04469 | −0.41481 |
| 1488 | 0.026668 | 0.389611 | 0.458541 |
| 1489 | −0.005825 | 0.171399 | 0.198891 |
| 1490 | 0.012848 | −0.13059 | −0.27898 |
| 1491 | 0.009565 | 0.278249 | 0.411315 |
| 1492 | 0.021342 | 0.506882 | 0.624826 |
| 1493 | 0.015718 | 0.181933 | 0.47929 |
| 1496 | 0.013599 | 0.429026 | 0.495775 |
| 1497 | 0.024594 | 0.441141 | 0.609581 |
| 1498 | −0.02213 | −0.09246 | −0.48339 |
| 1499 | −0.00567 | −0.17376 | −0.27031 |
| 1501 | −0.00667 | −0.18173 | −0.30221 |
| 1503 | −0.010846 | 0.33961 | 0.344346 |
| 1504 | −0.06109 | −0.27532 | −0.99929 |
| 1505 | −0.01809 | 0.200674 | 0.364344 |
| 1506 | 0.023044 | 0.113155 | 0.368896 |
| 1507 | 0.026059 | 0.263047 | 0.471704 |
| 1508 | 0.033535 | 0.256586 | 0.32019 |
| 1509 | −0.0239 | −0.03673 | −0.35743 |
| 1510 | 0.03368 | 0.34375 | 0.510758 |
| 1511 | 0.010537 | 0.277434 | 0.432917 |
| 1512 | −0.00969 | 0.1048 | 0.433681 |
| 1513 | 0.001754 | 0.123049 | 0.167595 |
| 1514 | 0.030431 | 0.203857 | 0.318761 |
| 1515 | −0.00509 | 0.125818 | 0.326768 |
| 1516 | 0.017355 | 0.270116 | 0.499174 |
| 1517 | 0.017165 | 0.337002 | 0.583633 |
| 1518 | 0.003625 | 0.464803 | 0.525035 |
| 1519 | 0.022947 | 0.422269 | 0.513847 |
| 1520 | 0.024372 | 0.086503 | 0.336729 |
| 1521 | −0.00251 | −0.32015 | −0.61272 |
| 1523 | −0.0274 | 0.203263 | 0.441664 |
| 1524 | 0.017389 | 0.201876 | 0.298552 |
| 1525 | 0.008877 | 0.323243 | 0.464502 |
| 1528 | −0.03814 | −0.28518 | −0.64558 |
| 1529 | 0.040359 | 0.291133 | 0.440437 |
| 1530 | 0.013253 | 0.217564 | 0.372946 |
| 1531 | −0.02213 | 0.36312 | 0.424709 |
| 1533 | −0.00695 | 0.322166 | 0.394893 |
| 1535 | 0.010588 | −0.22576 | −0.25635 |
| 1536 | −0.0106 | −0.25536 | −0.236 |
| 1537 | −0.0322 | −0.27265 | −0.39659 |
| 1538 | 0.011885 | 0.204677 | 0.431599 |
| 1539 | 0.008023 | 0.488543 | 0.649884 |
| 1540 | −0.02315 | −0.16887 | −0.43984 |
| 1541 | 0.009146 | −0.14302 | −0.31947 |
| 1542 | 0.015491 | 0.386882 | 0.63046 |
| 1543 | 0.01939 | 0.235471 | 0.438562 |
| 1544 | −0.00477 | −0.05625 | −0.39768 |
| 1545 | 0.01744 | −0.11171 | −0.15471 |
| 1546 | 0.017138 | 0.159288 | 0.280803 |
| 1547 | 0.008454 | 0.204783 | 0.373508 |
| 1548 | 0.006946 | 0.117129 | 0.370031 |
| 1550 | 0.006569 | −0.17032 | −0.21047 |
| 1551 | 0.010456 | −0.16989 | −0.21716 |
| 1552 | 0.030211 | 0.185262 | 0.280092 |
| 1553 | 0.027168 | 0.524054 | 0.552336 |
| 1554 | 0.025322 | 0.444269 | 0.547777 |
| 1555 | 0.007427 | 0.098115 | 0.323853 |
| 1556 | 0.007421 | 0.221284 | 0.290206 |
| 1557 | 0.026252 | 0.261143 | 0.495766 |
| 1558 | −0.04298 | −0.28254 | −1.01018 |
| 1559 | −0.05711 | 0.732732 | 0.781747 |
| 1560 | 0.005559 | −0.19059 | −0.29348 |
| 1561 | −0.02338 | −0.13568 | −0.40966 |
| 1562 | 0.025281 | 0.604143 | 0.684583 |
| 1563 | −0.03243 | 0.483388 | 0.507809 |
| 1564 | −0.00686 | 0.121216 | 0.464941 |
| 1565 | −0.01559 | −0.34333 | −0.38524 |
| 1567 | 0.027937 | 0.392011 | 0.694665 |
| 1568 | 0.003947 | 0.306649 | 0.252871 |
| 1569 | 0.0119 | 0.050554 | 0.34703 |
| 1570 | −0.01613 | 0.291768 | 0.433549 |
| 1571 | −0.03333 | −0.03399 | −0.54251 |
| 1572 | −0.02871 | 0.308957 | 0.461847 |

TABLE 1a-continued phase reporter genes

| SEQ ID NO | log(ratio) CP | log(ratio) AP | log(ratio) BC |
|---|---|---|---|
| 1573 | 0.008427 | −0.19856 | −0.17834 |
| 1574 | −0.00966 | 0.061794 | −0.50523 |
| 1575 | −0.04733 | −0.23751 | −0.34215 |
| 1576 | 0.030722 | 0.309089 | 0.579601 |
| 1577 | −0.04503 | −0.32515 | −1.47513 |
| 1578 | 0.013108 | 0.173541 | 0.325898 |
| 1579 | 0.039573 | 0.455784 | 0.593108 |
| 1580 | 0.01488 | 0.167381 | 0.337448 |
| 1581 | 0.01578 | 0.966015 | 0.747213 |
| 1582 | 0.021767 | −0.06571 | −0.22201 |
| 1583 | −0.03377 | 0.957743 | 0.952139 |
| 1584 | 0.000102 | 0.375168 | 0.427444 |
| 1585 | 0.012221 | 0.364757 | 0.498008 |
| 1586 | −0.05968 | 0.131214 | 0.231979 |
| 1587 | −0.00129 | 0.256818 | 0.354398 |
| 1588 | −0.02064 | 0.251769 | 0.448226 |
| 1589 | −0.00735 | −0.29792 | −0.46534 |
| 1590 | 0.000483 | −0.24237 | −0.56028 |
| 1592 | 0.005932 | 1.051292 | 1.07381 |
| 1593 | 0.023196 | −0.1622 | −0.44821 |
| 1594 | −0.00259 | −0.26185 | −0.42202 |
| 1595 | 0.016322 | 0.245038 | 0.401239 |
| 1596 | −0.012267 | 0.315077 | 0.462982 |
| 1597 | 0.013869 | 0.626753 | 0.569707 |
| 1598 | 0.01648 | 0.44301 | 0.702287 |
| 1599 | −0.00148 | −0.17565 | −0.30065 |
| 1600 | 0.021685 | 0.273528 | 0.471675 |
| 1601 | 0.011557 | 0.134017 | 0.300655 |
| 1602 | −0.03634 | −0.1835 | −0.37405 |
| 1603 | −0.05299 | −0.10304 | −0.76 |
| 1604 | 0.027767 | 0.464555 | 0.635743 |
| 1605 | −0.01022 | −0.11629 | −0.70459 |
| 1606 | 0.016358 | 0.157395 | 0.275139 |
| 1607 | 0.025792 | 0.397509 | 0.672154 |
| 1609 | −0.01086 | −0.0143 | 0.380983 |
| 1610 | −0.03769 | −0.15816 | −1.14581 |
| 1611 | 0.026536 | 0.611073 | 0.637773 |
| 1612 | 0.009768 | −0.17633 | −0.20219 |
| 1613 | 0.018672 | 0.639835 | 0.686131 |
| 1614 | −0.00595 | −0.17151 | −0.41225 |
| 1615 | −0.03355 | −0.29946 | −0.40616 |
| 1616 | −0.00505 | 0.107402 | 0.15699 |
| 1617 | −0.04052 | −0.29872 | −0.68389 |
| 1618 | −0.00668 | 1.111867 | 1.053921 |
| 1619 | 0.015573 | −0.03576 | −0.21323 |
| 1620 | 0.020609 | 0.286474 | 0.393224 |
| 1621 | −0.0087 | 0.323935 | 0.339016 |
| 1622 | 0.022252 | 0.265231 | 0.499298 |
| 1623 | 0.0309 | 0.498198 | 0.657198 |
| 1624 | −0.003494 | −0.128858 | −0.416283 |
| 1625 | −0.05632 | −0.39999 | −0.43886 |
| 1626 | −0.0135 | 0.314884 | 0.649048 |
| 1627 | 0.028772 | 0.488679 | 0.759761 |
| 1628 | 0.00467 | 0.427485 | 0.588063 |
| 1629 | 0.002155 | 0.764925 | 0.732094 |
| 1630 | 0.025418 | 0.22508 | 0.31406 |
| 1631 | −0.01046 | 0.209115 | 0.386983 |
| 1632 | −0.01049 | 0.878023 | 0.775566 |
| 1633 | 0.025532 | 0.342507 | 0.502738 |
| 1634 | 0.015481 | 0.560252 | 0.538429 |
| 1635 | −0.04353 | 0.259742 | 0.659249 |
| 1636 | 0.020275 | 0.093339 | 0.361063 |
| 1637 | 0.007208 | 0.157407 | 0.25487 |
| 1638 | −0.04262 | −0.28323 | −0.87579 |
| 1639 | 0.051421 | 0.491945 | 0.653117 |
| 1640 | −0.01018 | 0.347268 | 0.588021 |
| 1641 | −0.04504 | −0.35082 | −0.89888 |
| 1642 | −0.02474 | −0.25739 | −0.47619 |
| 1644 | −0.01609 | −0.09535 | −0.5932 |
| 1645 | −0.03235 | −0.16356 | −0.39665 |
| 1646 | 0.028968 | 0.32258 | 0.520166 |
| 1647 | 0.032173 | 0.590062 | 0.811258 |
| 1648 | −0.02776 | −0.13951 | −0.5018 |
| 1649 | −0.00272 | 0.163307 | 0.253524 |
| 1650 | 0.019266 | 0.438798 | 0.499089 |
| 1651 | 0.005638 | −0.13247 | −0.31381 |
| 1653 | −0.00021 | 0.090548 | 0.295377 |
| 1654 | −0.005 | −0.24979 | −0.53688 |
| 1655 | −0.07359 | 0.053071 | −0.91511 |
| 1656 | 0.007697 | 0.469061 | 0.570563 |
| 1658 | 0.0295 | 0.19296 | 0.359484 |
| 1659 | 0.010231 | 0.902353 | 0.804032 |
| 1660 | −0.00649 | −0.15261 | −0.1773 |
| 1661 | 0.012219 | 0.613912 | 0.549935 |
| 1662 | −0.06415 | −0.43774 | −0.43472 |
| 1663 | −0.0078 | −0.18865 | −0.16956 |
| 1664 | 0.016452 | 0.122548 | 0.318295 |
| 1665 | −0.09894 | −0.44748 | −1.18835 |
| 1666 | 0.007163 | 0.450631 | 0.65784 |
| 1667 | 0.020618 | −0.152906 | −0.073514 |
| 1668 | −0.01219 | −0.23803 | −0.24918 |
| 1669 | 0.029924 | 0.452512 | 0.78049 |
| 1670 | 0.008377 | −0.24035 | −0.39003 |
| 1672 | −0.02109 | −0.04326 | −0.9614 |
| 1673 | −0.0073 | −0.28445 | −0.2691 |
| 1674 | 0.001052 | 0.230389 | 0.365551 |
| 1675 | −0.00228 | 0.235454 | 0.555381 |
| 1676 | −0.03523 | 0.279516 | 0.556005 |
| 1677 | 0.014496 | 0.700022 | 0.772568 |
| 1678 | −0.00423 | −0.26803 | −0.59474 |
| 1679 | −0.01749 | 0.064239 | 0.393283 |
| 1680 | 0.014303 | −0.15699 | −0.52949 |
| 1681 | 0.003697 | 0.131817 | 0.317734 |
| 1682 | −0.00306 | −0.17935 | −0.30964 |
| 1683 | −0.0044 | 0.152742 | 0.356869 |
| 1684 | −0.07893 | −0.43101 | −0.57506 |
| 1685 | −0.026 | −0.35847 | −0.50814 |
| 1686 | 0.016683 | −0.18902 | −0.1842 |
| 1687 | −0.01704 | −0.2493 | −0.23759 |
| 1688 | 0.008536 | −0.19671 | −0.16612 |
| 1690 | 0.034281 | 0.168494 | 0.297968 |
| 1691 | −0.04203 | −0.24984 | −0.58657 |
| 1692 | 0.040546 | 0.2054 | 0.409934 |
| 1693 | −0.00929 | 0.113601 | 0.330141 |
| 1694 | 0.022539 | 0.351281 | 0.470963 |
| 1695 | 0.029892 | 0.267705 | 0.486644 |
| 1696 | −0.00019 | −0.22543 | −0.49238 |
| 1697 | −0.01354 | −0.06666 | −0.54425 |
| 1698 | 0.005153 | −0.16834 | −0.24091 |
| 1699 | 0.01957 | 0.216329 | 0.399487 |
| 1700 | −0.03822 | 0.049127 | −0.79641 |
| 1701 | −0.02074 | 0.357989 | 0.53794 |
| 1702 | −0.01378 | 0.190993 | 0.424559 |
| 1703 | −0.05184 | −0.19677 | −0.78632 |
| 1704 | 0.025577 | 0.210863 | 0.323976 |
| 1705 | 0.02774 | 0.305447 | 0.724292 |
| 1706 | 0.017741 | 0.35252 | 0.640083 |
| 1707 | −0.10203 | −0.508005 | −0.433948 |
| 1709 | 0.003448 | 0.250131 | 0.265264 |
| 1710 | −0.02108 | 0.135059 | 0.6295 |
| 1713 | −0.000033 | 0.227119 | 0.293211 |
| 1714 | −0.00418 | 0.263371 | 0.406272 |
| 1715 | 0.02106 | 0.336823 | 0.533121 |
| 1716 | 0.000778 | −0.28099 | −0.34591 |
| 1717 | 0.067455 | 0.340627 | 0.53487 |
| 1718 | −0.00514 | −0.18407 | −0.44943 |
| 1719 | 0.025175 | 0.199487 | 0.343829 |
| 1720 | 0.010343 | 0.282449 | 0.476896 |
| 1721 | −0.06784 | −0.30027 | −0.86635 |
| 1722 | −0.02954 | 0.372542 | 0.464872 |
| 1723 | 0.014127 | 0.37886 | 0.600633 |
| 1725 | −0.03063 | −0.15378 | −0.66852 |
| 1726 | 0.005904 | −0.22601 | −0.39312 |
| 1727 | 0.016504 | 0.319758 | 0.47473 |
| 1729 | −0.03897 | 0.806008 | 1.067372 |
| 1730 | −0.0123 | −0.28524 | −0.2969 |
| 1732 | 0.018434 | −0.15661 | −0.14247 |
| 1733 | −0.02347 | −0.17755 | −0.57093 |
| 1734 | 0.018422 | 0.189645 | 0.382171 |
| 1735 | 0.023911 | 0.165244 | 0.391311 |

TABLE 1a-continued phase reporter genes

| SEQ ID NO | log(ratio) CP | log(ratio) AP | log(ratio) BC |
|---|---|---|---|
| 1736 | −0.01529 | −0.19416 | −0.4205 |
| 1737 | 0.009313 | −0.12753 | −0.23184 |
| 1738 | −0.05497 | −0.17588 | −0.45726 |
| 1739 | −0.00577 | −0.13309 | −0.61854 |
| 1740 | 0.000129 | 0.082648 | 0.202706 |
| 1741 | 0.003693 | 0.225827 | 0.345689 |
| 1742 | 0.031605 | 0.089372 | 0.312142 |
| 1743 | 0.010364 | 0.348908 | 0.367908 |
| 1744 | −0.02434 | −0.09144 | 0.156156 |
| 1745 | −0.02231 | −0.20802 | −0.22645 |
| 1746 | −0.04199 | −0.25892 | −1.00436 |
| 1747 | −0.01659 | −0.1995 | −0.30164 |
| 1748 | −0.03118 | −0.26385 | −0.39963 |
| 1749 | 0.001133 | −0.16781 | −0.22877 |
| 1750 | −0.0074 | −0.24548 | −0.5296 |
| 1751 | 0.030846 | 0.50771 | 0.564782 |
| 1752 | −0.0023 | 0.557287 | 0.447554 |
| 1753 | 0.044274 | −0.18457 | −0.17418 |
| 1754 | 0.005458 | 0.258669 | 0.438507 |
| 1755 | 0.026709 | 0.265936 | 0.433134 |
| 1756 | −0.07289 | −0.28387 | −0.87405 |
| 1759 | 0.017564 | 0.231565 | 0.588896 |
| 1760 | −0.00904 | −0.20562 | −0.2297 |
| 1761 | 0.034479 | 0.143745 | 0.281478 |
| 1763 | 0.002059 | 0.422689 | 0.661307 |
| 1764 | 0.015931 | 0.381083 | 0.601851 |
| 1765 | −0.069608 | 0.229406 | −0.942888 |
| 1766 | −0.01109 | 0.23371 | 0.474147 |
| 1768 | 0.04507 | 0.229723 | 0.345461 |
| 1769 | −0.07627 | 0.156128 | 0.250496 |
| 1770 | 0.01144 | 0.346982 | 0.490984 |
| 1771 | −0.02162 | −0.28795 | −0.27807 |
| 1772 | 0.019225 | 0.236177 | 0.441341 |
| 1775 | 0.022918 | 0.183774 | 0.301866 |
| 1777 | 0.010911 | 0.118611 | 0.209198 |
| 1778 | −0.05232 | −0.2939 | −1.18191 |
| 1779 | 0.011474 | 0.267102 | 0.353548 |
| 1780 | 0.032706 | 0.233902 | 0.480801 |
| 1782 | −0.00163 | −0.14093 | −0.26973 |
| 1783 | 0.030167 | 0.180356 | 0.299337 |
| 1784 | 0.015401 | 0.594929 | 0.862054 |
| 1785 | −0.00264 | 0.291894 | 0.36507 |
| 1787 | −0.01282 | −0.21492 | −0.34306 |
| 1788 | 0.009731 | −0.13302 | −0.11645 |
| 1789 | −0.00598 | −0.0331 | −0.28125 |
| 1790 | 0.008607 | −0.16296 | −0.20062 |
| 1791 | 0.002438 | 0.388732 | 0.329922 |
| 1792 | 0.001959 | 0.023872 | 0.208334 |
| 1793 | 0.010073 | 0.404828 | 0.426744 |
| 1794 | −0.03895 | −0.21887 | −0.5835 |
| 1795 | −0.0592 | −0.09279 | −0.44737 |
| 1796 | −0.0262 | −0.25466 | −0.21655 |
| 1797 | −0.12257 | −0.31528 | −1.5223 |
| 1798 | 0.006863 | 0.125618 | 0.179833 |
| 1801 | 0.002794 | −0.12806 | −0.33744 |
| 1802 | −0.006187 | −0.271892 | −0.547214 |
| 1803 | −0.02679 | −0.23885 | −0.46079 |
| 1804 | 0.007217 | −0.21745 | −0.20809 |
| 1805 | −0.11509 | −0.38375 | −0.60223 |
| 1806 | −0.02318 | −0.33783 | −1.07263 |
| 1807 | −0.00505 | −0.2652 | −0.35813 |
| 1808 | 0.004754 | 0.169766 | 0.345844 |
| 1809 | −0.01864 | −0.17631 | −0.30283 |
| 1810 | −0.01537 | −0.11929 | −0.49832 |
| 1811 | −0.02414 | −0.22298 | −0.56307 |
| 1812 | −0.05789 | −0.46577 | −0.67116 |
| 1813 | 0.004929 | 0.074195 | −0.38902 |
| 1814 | −0.12994 | −0.5422 | −0.67394 |
| 1816 | 0.000462 | −0.29172 | −0.78629 |
| 1817 | −0.05267 | −0.08425 | −0.56209 |
| 1818 | 0.021928 | 0.103957 | 0.612197 |
| 1819 | −0.04001 | −0.08007 | −0.62152 |
| 1821 | 0.012366 | 0.608222 | 0.811802 |
| 1822 | 0.008709 | 0.058535 | 0.172787 |
| 1824 | 0.055901 | 1.019295 | 1.14166 |
| 1825 | −0.01941 | −0.32585 | −0.35338 |
| 1826 | 0.024815 | 0.359143 | 0.586203 |
| 1827 | −0.01719 | −0.20544 | −0.21855 |
| 1829 | −0.0351 | 0.382362 | 0.463074 |
| 1830 | 0.012246 | −0.22063 | −0.17454 |
| 1831 | −0.01595 | −0.15761 | −0.40073 |
| 1832 | 0.018962 | 0.22087 | 0.566994 |
| 1833 | 0.029653 | 0.034092 | 0.253365 |
| 1834 | −0.01445 | −0.24365 | −0.30384 |
| 1835 | −0.02682 | −0.22033 | −0.32568 |
| 1836 | −0.09901 | −0.30331 | −1.47414 |
| 1837 | 0.030238 | 0.239652 | 0.470628 |
| 1838 | 0.002423 | −0.19623 | −0.5761 |
| 1841 | −0.03342 | −0.13149 | −0.66763 |
| 1842 | 0.029358 | 0.337117 | 0.459639 |
| 1843 | 0.001903 | −0.21172 | −0.37406 |
| 1844 | −0.03995 | −0.30379 | −0.41743 |
| 1845 | −0.00479 | −0.13037 | −0.30756 |
| 1846 | −0.00041 | −0.34946 | −0.65983 |
| 1847 | −0.00414 | −0.14024 | −0.31772 |
| 1848 | −0.01386 | −0.22644 | −0.32931 |
| 1850 | 0.01079 | 0.211982 | 0.326417 |
| 1851 | −0.02231 | −0.2043 | −1.19046 |
| 1852 | 0.015181 | 0.111086 | 0.251967 |
| 1853 | −0.01527 | −0.28004 | −0.47715 |
| 1854 | 0.000932 | −0.24516 | −0.28454 |
| 1855 | 0.033597 | 0.184815 | 0.265554 |
| 1856 | −0.03302 | −0.34634 | −0.76554 |
| 1857 | 0.005193 | −0.22844 | −0.62729 |
| 1858 | −0.05483 | −0.30502 | −0.82935 |
| 1859 | 0.001499 | −0.10385 | −0.32329 |
| 1860 | 0.013105 | 0.210462 | 0.248993 |
| 1861 | 0.008675 | 0.496561 | 0.927091 |
| 1862 | 0.010826 | −0.21583 | −0.30859 |
| 1863 | −0.02181 | −0.43456 | −0.94264 |
| 1864 | −0.01059 | −0.24026 | −0.50607 |
| 1865 | −0.01382 | 0.374521 | 0.555237 |
| 1866 | −0.12558 | −0.46355 | −1.21848 |
| 1867 | 0.016134 | −0.25351 | −0.57052 |
| 1868 | 0.001577 | 0.372509 | 0.34609 |
| 1869 | −0.14247 | −0.50568 | −1.11469 |
| 1871 | −0.03321 | −0.44414 | −1.2074 |
| 1872 | 0.022755 | 0.237358 | 0.526712 |
| 1874 | 0.015851 | 0.398675 | 0.461731 |
| 1875 | 0.028164 | 0.290971 | 0.40534 |
| 1876 | −0.00363 | 0.330491 | 0.472481 |
| 1877 | −0.01271 | −0.28482 | −0.41247 |
| 1878 | −0.05324 | −0.21202 | −0.97494 |
| 1879 | −0.01231 | 0.272185 | 0.50145 |
| 1880 | 0.009419 | −0.16361 | −0.28568 |
| 1881 | 0.024008 | 0.385428 | 0.510505 |
| 1882 | −0.01343 | −0.30202 | −0.25117 |
| 1883 | 0.019995 | 0.230682 | 0.273889 |
| 1884 | −0.0234 | 0.35963 | 0.444844 |
| 1885 | 0.026138 | 0.213097 | 0.383805 |
| 1886 | −0.00891 | 0.004522 | −0.56889 |
| 1887 | −0.00744 | −0.28972 | −0.55691 |
| 1888 | 0.016743 | 0.303348 | 0.429235 |
| 1889 | 0.001491 | 0.145451 | 0.360623 |
| 1890 | −0.00739 | −0.14358 | −0.51551 |
| 1891 | −0.01196 | −0.17613 | −0.29865 |
| 1892 | −0.04341 | −0.18291 | −1.32937 |
| 1894 | 0.036374 | 0.308875 | 0.347083 |
| 1895 | −0.01486 | −0.35427 | −0.75272 |
| 1896 | 0.020399 | −0.17097 | −0.28996 |
| 1897 | 0.00121 | −0.17923 | −0.19633 |
| 1899 | −0.02719 | −0.20241 | −0.70406 |
| 1900 | −0.00544 | −0.1899 | −0.31452 |
| 1901 | −0.02757 | −0.18302 | −1.14281 |
| 1902 | 0.002335 | −0.21384 | −0.30124 |
| 1903 | 0.022039 | 0.236533 | 0.451828 |
| 1904 | −0.02356 | −0.35422 | −0.59893 |
| 1905 | 0.012193 | 0.149476 | 0.324708 |
| 1906 | −0.018987 | −0.066969 | −0.26783 |
| 1907 | 0.006033 | 0.110037 | 0.284895 |

TABLE 1a-continued phase reporter genes

| SEQ ID NO | log(ratio) CP | log(ratio) AP | log(ratio) BC |
|---|---|---|---|
| 1908 | 0.001763 | −0.19256 | −0.24906 |
| 1909 | −0.03746 | −0.27994 | −0.98912 |
| 1910 | −0.014553 | −0.104128 | −0.202699 |
| 1911 | −0.00195 | −0.19606 | −0.26083 |
| 1912 | −0.00425 | −0.25347 | −0.32548 |
| 1913 | −0.09292 | −0.0302 | −0.94519 |
| 1914 | −0.01006 | −0.17543 | −0.72417 |
| 1915 | 0.016217 | −0.11786 | −0.33524 |
| 1916 | −0.23712 | −0.79448 | −1.17987 |
| 1917 | 0.020851 | −0.31695 | −0.30797 |
| 1918 | −0.00017 | −0.20379 | −0.42295 |
| 1919 | 0.003761 | 0.079721 | 0.31422 |
| 1920 | −0.01211 | −0.21388 | −0.23505 |
| 1921 | −0.23852 | −0.78111 | −1.15703 |
| 1922 | −0.01943 | −0.36905 | −0.84702 |
| 1923 | −0.11396 | −0.29114 | −1.28313 |
| 1924 | −0.02134 | −0.19369 | −0.87972 |
| 1925 | 0.019202 | −0.23042 | −0.31619 |
| 1927 | 0.016189 | 0.022638 | −0.210103 |
| 1928 | −0.11288 | −0.43825 | −1.01888 |
| 1929 | −0.15456 | −0.55089 | −1.75387 |
| 1930 | −0.04421 | −0.41059 | −1.08044 |
| 1931 | −0.02591 | −0.15838 | −0.64711 |
| 1932 | −0.03919 | −0.38915 | −1.40276 |
| 1933 | 0.017422 | 0.39976 | 0.60926 |
| 1934 | −0.09323 | −0.42485 | −1.39982 |
| 1935 | −0.00778 | −0.23173 | −0.65059 |
| 1936 | −0.04034 | −0.37519 | −0.84927 |
| 1937 | −0.00128 | 0.221931 | 0.260665 |
| 1938 | −0.02216 | −0.35136 | −0.76624 |
| 1939 | −0.04121 | −0.30657 | −0.73842 |
| 1940 | −0.00255 | −0.03829 | −0.60883 |
| 1941 | 0.001721 | −0.28062 | −0.72685 |
| 1942 | −0.0357 | −0.30908 | −0.99946 |
| 1943 | 0.001724 | 0.258581 | 0.240667 |
| 1945 | −0.02465 | −0.27186 | −0.86081 |
| 1946 | −0.08093 | −0.47696 | −1.43226 |
| 1947 | −0.03385 | −0.32059 | −0.3286 |
| 1950 | 0.002196 | −0.17359 | −0.19672 |
| 1951 | 0.006991 | −0.20072 | −0.25329 |
| 1952 | −0.00608 | −0.40942 | −0.73578 |
| 1953 | 0.005028 | −0.15884 | −0.16945 |
| 1954 | −0.01496 | −0.38759 | −0.80625 |
| 1955 | −0.00401 | −0.23755 | −0.2686 |
| 1956 | −0.0131 | −0.35273 | −0.47846 |
| 1957 | −0.33149 | −0.64113 | −1.67356 |
| 1958 | 0.011706 | 0.158574 | 0.307924 |
| 1960 | 0.001843 | 0.620171 | 0.791092 |
| 1961 | 0.007272 | 0.209398 | 0.407065 |
| 1962 | −0.03168 | −0.28618 | −0.39373 |
| 1963 | −0.03105 | −0.33984 | −1.10317 |
| 1964 | −0.02235 | −0.19517 | −0.60335 |
| 1966 | −0.01351 | −0.15096 | −0.50109 |
| 1967 | −0.0447 | −0.30407 | −0.77666 |
| 1968 | 0.018818 | 0.632814 | 1.006789 |
| 1969 | −0.02596 | −0.08579 | −0.5593 |
| 1970 | −0.00539 | −0.12713 | −0.51489 |
| 1971 | −0.00231 | −0.27674 | −0.53183 |
| 1972 | 0.011694 | −0.16092 | −0.17151 |
| 1973 | 0.025222 | 0.269645 | −0.254999 |
| 1974 | 0.005887 | −0.23322 | −0.3102 |
| 1975 | 0.010273 | 0.158669 | 0.375971 |
| 1976 | 0.01164 | 0.069451 | 0.30272 |
| 1977 | 0.003153 | 0.020107 | 0.291161 |
| 1978 | 0.010275 | 0.035343 | 0.290966 |
| 1979 | −0.00726 | 0.290123 | 0.41272 |
| 1980 | 0.027274 | 0.114447 | 0.317692 |
| 1981 | −0.00299 | −0.18464 | −0.18655 |
| 1982 | 0.003371 | −0.20588 | −0.27555 |
| 1983 | −0.02234 | −0.24084 | −0.25563 |
| 1984 | −0.01421 | −0.27928 | −0.47362 |
| 1985 | −0.01976 | −0.32802 | −0.50237 |
| 1986 | 0.007511 | 0.140653 | 0.381245 |
| 1987 | −0.07456 | −0.17753 | −1.53576 |
| 1988 | −0.11518 | −0.48269 | −0.6296 |
| 1989 | −0.02835 | −0.34393 | −0.51483 |
| 1992 | 0.025232 | 0.10373 | 0.212754 |
| 1993 | −0.01001 | 0.495077 | 0.431265 |
| 1994 | 0.011564 | 0.199355 | 0.29528 |
| 1995 | −0.08513 | −0.34241 | −0.75858 |
| 1996 | 0.009808 | −0.08644 | −0.66723 |
| 1997 | −0.00362 | −0.24336 | −0.58573 |
| 1998 | −0.027543 | −0.140155 | −0.699914 |
| 1999 | 0.010602 | 0.381886 | 0.466869 |
| 2000 | 0.005232 | 0.090412 | 0.303792 |
| 2001 | −0.04158 | −0.10036 | −0.75716 |
| 2002 | 0.00709 | −0.25448 | −0.42862 |
| 2003 | 0.020328 | 0.349002 | 0.540023 |
| 2004 | −0.10392 | −0.26626 | −1.14552 |
| 2005 | −0.00395 | −0.14092 | −0.81253 |
| 2006 | 0.018924 | 0.16205 | 0.301643 |
| 2008 | 0.017035 | −0.18494 | −0.32494 |
| 2009 | −0.0108 | −0.2725 | −0.60257 |
| 2010 | 0.062715 | 0.858399 | 1.070711 |
| 2011 | −0.00319 | −0.23151 | −0.40707 |
| 2013 | 0.016426 | 0.585105 | 0.735072 |
| 2014 | 0.015113 | −0.07451 | −0.25615 |
| 2015 | 0.015706 | 0.227053 | 0.434043 |
| 2016 | −0.01066 | −0.06296 | −0.26564 |
| 2017 | 0.029794 | 0.296055 | 0.351559 |
| 2018 | 0.029692 | 0.437282 | 0.898887 |
| 2019 | 0.021497 | 0.043623 | 0.287068 |
| 2020 | 0.012762 | −0.00058 | 0.249706 |
| 2021 | 0.019174 | 0.298194 | 0.539625 |
| 2022 | −0.00953 | 0.15747 | 0.378583 |
| 2024 | 0.002746 | 0.021635 | 0.240366 |
| 2025 | −0.01867 | 0.148242 | 0.393055 |
| 2026 | 0.012409 | 0.29772 | 0.537753 |
| 2027 | −0.10141 | −0.42795 | −0.96011 |
| 2028 | −0.04498 | −0.43649 | −1.45709 |
| 2029 | −0.00698 | 0.084208 | 0.226775 |
| 2030 | −0.01906 | −0.07943 | −0.3736 |
| 2031 | 0.037343 | 0.135145 | 0.345018 |
| 2034 | 0.016288 | 0.26475 | 0.36449 |
| 2035 | 0.006041 | −0.39239 | −0.2779 |
| 2036 | 0.005805 | −0.16315 | −0.18766 |
| 2037 | 0.008439 | −0.20905 | −0.20892 |
| 2038 | −0.04899 | −0.25655 | −0.65559 |
| 2039 | 0.008925 | −0.17251 | −0.16471 |
| 2041 | 0.025259 | 0.472669 | 0.602447 |
| 2042 | 0.003359 | −0.068862 | −0.130822 |
| 2043 | −0.02582 | −0.14361 | −0.66288 |
| 2044 | 0.009058 | 0.271975 | 0.401515 |
| 2045 | 0.003375 | 0.481213 | 0.58199 |
| 2046 | 0.030247 | 0.202417 | 0.360615 |
| 2047 | −0.01954 | −0.24101 | −0.52265 |
| 2048 | 0.02079 | 0.122979 | 0.287027 |
| 2049 | 0.01841 | 0.128683 | 0.297137 |
| 2050 | −0.07838 | −0.3133 | −0.81839 |
| 2051 | 0.035655 | 0.12048 | 0.325558 |
| 2052 | 0.019567 | 0.208663 | 0.305192 |
| 2053 | 0.006616 | −0.14349 | −0.25109 |
| 2054 | 0.01283 | 0.763707 | 1.304963 |
| 2055 | 0.011199 | 0.145867 | 0.391723 |
| 2056 | 0.017212 | −0.089889 | −0.160576 |
| 2057 | 0.020607 | −0.18267 | −0.20839 |
| 2058 | −0.01011 | 0.234598 | 0.4539 |
| 2059 | 0.028485 | 0.975327 | 1.038984 |
| 2060 | −0.00122 | −0.11435 | −0.26342 |
| 2061 | 0.007696 | −0.15684 | −0.41357 |
| 2062 | −0.10026 | −0.36029 | −1.4428 |
| 2063 | −0.0135 | −0.27765 | −0.73306 |
| 2065 | 0.013947 | 0.089198 | 0.20872 |
| 2066 | −0.00563 | −0.28159 | −0.25268 |
| 2067 | −0.034481 | −0.314757 | −0.571005 |
| 2068 | 0.014892 | 0.234483 | 0.341533 |
| 2069 | 0.013673 | −0.24452 | −0.31746 |
| 2070 | −0.03035 | −0.24676 | −0.33611 |
| 2071 | 0.016716 | 0.069954 | 0.274927 |
| 2072 | −0.00023 | −0.14279 | −0.18875 |

TABLE 1a-continued phase reporter genes

| SEQ ID NO | log(ratio) CP | log(ratio) AP | log(ratio) BC |
|---|---|---|---|
| 2074 | 0.020103 | 0.397908 | 0.358054 |
| 2075 | 0.000883 | −0.16172 | −0.27555 |
| 2076 | 0.004859 | 0.17127 | 0.332493 |
| 2077 | 0.01037 | −0.21565 | −0.18888 |
| 2078 | −0.01703 | −0.29207 | −0.3353 |
| 2079 | 0.004482 | −0.13823 | −0.1988 |
| 2080 | −0.00423 | 0.264912 | 0.538955 |
| 2083 | −0.01884 | −0.22222 | −0.54983 |
| 2084 | 0.002429 | 0.191739 | 0.286946 |
| 2086 | −0.11171 | −0.3468 | −1.66202 |
| 2089 | −0.00222 | −0.2653 | −0.22905 |
| 2090 | −0.00873 | −0.25551 | −0.39288 |
| 2091 | 0.017863 | 0.3995 | 0.563314 |
| 2092 | −0.02737 | −0.29124 | −0.54792 |
| 2093 | 0.001438 | 0.393312 | 0.645013 |
| 2094 | −0.00161 | 0.329179 | 0.599467 |
| 2095 | −0.04662 | −0.4555 | −1.39345 |
| 2096 | 0.00868 | −0.14575 | −0.16084 |
| 2097 | −0.01069 | 0.438307 | 0.530558 |
| 2098 | 0.005224 | −0.1524 | −0.57137 |
| 2099 | −0.00512 | −0.23121 | −0.20581 |
| 2100 | 0.01594 | −0.11251 | −0.15343 |
| 2102 | −0.03821 | −0.13991 | −0.37379 |
| 2103 | −0.0791 | −0.56806 | −0.76943 |
| 2105 | −0.0032 | 0.184921 | 0.613022 |
| 2107 | 0.028212 | 0.476891 | 0.557632 |
| 2108 | 0.016664 | −0.18764 | −0.19983 |
| 2109 | 0.024344 | 0.270797 | 0.434368 |
| 2110 | 0.016946 | 0.26032 | 0.406567 |
| 2111 | −0.03403 | −0.18774 | −0.47693 |
| 2112 | −0.03586 | −0.18075 | −0.81904 |
| 2113 | −0.03026 | −0.30742 | −0.71977 |
| 2114 | 0.047553 | 1.260344 | 1.156552 |
| 2115 | −0.01266 | −0.26929 | −0.3155 |
| 2116 | −0.09454 | −0.21809 | −1.42535 |
| 2117 | −0.12163 | −0.41838 | −1.70565 |
| 2118 | −0.03225 | −0.24102 | −0.4328 |
| 2119 | −0.0277 | −0.23099 | −0.76403 |
| 2120 | 0.00625 | −0.06197 | −0.47991 |
| 2121 | −0.01834 | −0.27363 | −0.90414 |
| 2122 | 0.011765 | 0.253516 | 0.398825 |
| 2123 | 0.00067 | −0.1136 | −0.48147 |
| 2124 | 0.017464 | −0.20661 | −0.22346 |
| 2125 | −0.0182 | −0.13711 | −0.28222 |
| 2127 | −0.042666 | 0.689794 | 0.248637 |
| 2128 | 0.002977 | −0.20398 | −0.24483 |
| 2129 | −0.05143 | 0.803666 | 0.887101 |
| 2130 | 0.00574 | −0.21235 | −0.29382 |
| 2131 | −0.00303 | −0.18488 | −0.88168 |
| 2132 | −0.001535 | 0.140887 | 0.196882 |
| 2133 | −0.00393 | −0.06911 | −0.36393 |
| 2134 | −0.03722 | 0.513288 | 0.815222 |
| 2135 | −0.01418 | −0.07171 | −0.47154 |
| 2136 | −0.016679 | 0.5014 | 0.158751 |
| 2137 | −0.03413 | −0.34893 | −1.14123 |
| 2138 | 0.021545 | 0.163729 | 0.280431 |
| 2139 | 0.001657 | −0.20288 | −0.32099 |
| 2140 | −0.04362 | −0.26001 | −0.88714 |
| 2141 | −0.0604 | −0.3014 | −1.2413 |
| 2142 | 0.014533 | −0.1873 | −0.2803 |
| 2143 | −0.1554 | −0.1203 | −1.28143 |
| 2144 | −0.06871 | −0.3596 | −1.3171 |
| 2146 | −0.03532 | 0.861553 | 0.9609 |
| 2147 | −0.08402 | −0.07325 | −1.17694 |
| 2148 | 0.007504 | −0.089503 | −0.424451 |
| 2149 | −0.0109 | 0.3989 | 0.462382 |
| 2150 | 0.017122 | 0.249082 | 0.421175 |
| 2152 | 0.000207 | −0.21526 | −0.62205 |
| 2153 | −0.0968 | −0.31175 | −1.50181 |
| 2154 | 0.027642 | 0.21952 | 0.323357 |
| 2155 | −0.12683 | −0.4516 | −1.8255 |
| 2156 | 0.010058 | −0.11429 | −0.24262 |
| 2157 | 0.00001 | −0.29205 | −0.35927 |
| 2158 | 0.02961 | −0.09941 | −0.51043 |
| 2159 | −0.00806 | 0.652361 | 0.831233 |
| 2160 | 0.001866 | −0.1929 | −0.58327 |
| 2162 | −0.018781 | −0.151041 | −0.25681 |
| 2163 | 0.006228 | 0.064327 | 0.297762 |
| 2164 | −0.05889 | −0.38329 | −1.43636 |
| 2165 | 0.016516 | 0.619334 | 0.805191 |
| 2166 | −0.04869 | −0.23011 | −0.83923 |
| 2167 | 0.003504 | −0.18951 | −0.192 |
| 2168 | −0.02315 | −0.07567 | −0.8944 |
| 2169 | −0.03608 | −0.27598 | −1.16409 |
| 2170 | −0.02692 | −0.43046 | −1.39025 |
| 2171 | 0.002668 | −0.37727 | −0.52856 |
| 2173 | 0.012166 | 0.238158 | 0.457493 |
| 2175 | −0.01559 | −0.12915 | −0.2724 |
| 2176 | 0.025237 | −0.09022 | −0.19988 |
| 2177 | −0.03027 | −0.22427 | −1.29209 |
| 2179 | −0.000017 | 0.118178 | −0.51895 |
| 2180 | 0.016951 | 0.103897 | 0.333014 |
| 2182 | −0.01191 | −0.17284 | −0.30344 |
| 2184 | −0.03966 | −0.14011 | −0.49395 |
| 2185 | −0.01437 | −0.17107 | −0.62149 |
| 2186 | 0.01792 | 0.058324 | 0.385451 |
| 2187 | 0.014317 | 0.571045 | 0.979284 |
| 2188 | 0.010466 | −0.25055 | −0.42237 |
| 2190 | 0.018541 | 0.327989 | 0.417322 |
| 2191 | −0.0577 | −0.35017 | −0.72494 |
| 2192 | −0.0357 | −0.26097 | −0.34259 |
| 2193 | 0.006228 | −0.2797 | −0.73328 |
| 2194 | 0.015071 | 0.359311 | 0.477458 |
| 2195 | 0.005636 | −0.20457 | −0.22518 |
| 2196 | 0.001252 | −0.045446 | −0.145241 |
| 2197 | 0.019099 | 0.161504 | 0.47798 |
| 2198 | 0.013844 | −0.2143 | −0.37091 |
| 2201 | −0.02295 | −0.15527 | −0.34364 |
| 2202 | −0.05247 | −0.1837 | −1.02532 |
| 2203 | 0.013674 | 0.140593 | 0.249899 |
| 2204 | −0.0042 | −0.15621 | −0.88249 |
| 2205 | −0.03294 | −0.48168 | −1.48088 |
| 2208 | −0.0036 | −0.14616 | −0.24644 |
| 2209 | 0.007125 | 0.199427 | 0.311049 |
| 2210 | 0.002471 | 0.203327 | 0.374323 |
| 2211 | −0.02716 | −0.35947 | −0.74654 |
| 2213 | 0.022013 | 0.236032 | 0.427654 |
| 2214 | −0.0196 | −0.21397 | −0.72637 |
| 2215 | −0.00274 | −0.14692 | −0.25459 |
| 2216 | −0.00131 | −0.17937 | −0.19394 |
| 2217 | −0.02213 | −0.13748 | −0.35095 |
| 2218 | −0.001994 | 0.132273 | 0.102983 |
| 2219 | −0.01994 | −0.35781 | −0.39975 |
| 2220 | 0.000037 | −0.30384 | −0.35871 |
| 2221 | −0.05789 | −0.22934 | −0.50878 |
| 2222 | 0.008979 | 0.538623 | 0.735942 |
| 2223 | −0.01819 | −0.49118 | −0.4376 |
| 2225 | 0.003237 | −0.23548 | −0.30838 |
| 2226 | −0.0949 | −0.38963 | −1.44171 |
| 2227 | −0.00725 | 0.248686 | 0.395542 |
| 2229 | 0.009271 | 0.114522 | 0.376512 |
| 2230 | 0.00848 | 0.206059 | 0.401043 |
| 2231 | 0.003439 | −0.20575 | −0.19678 |
| 2232 | −0.02501 | −0.18181 | −0.55661 |
| 2233 | 0.000061 | −0.20966 | −0.25777 |
| 2234 | 0.012291 | −0.1024 | −0.19623 |
| 2235 | 0.012667 | −0.11775 | −0.14831 |
| 2236 | −0.04859 | −0.21001 | −0.44239 |
| 2237 | −0.01381 | −0.12472 | −0.48142 |
| 2238 | 0.03163 | 0.593249 | 0.946711 |
| 2239 | 0.012068 | 0.31605 | 0.517375 |
| 2240 | −0.00959 | −0.37927 | −0.9435 |
| 2241 | −0.00071 | −0.20447 | −0.16281 |
| 2242 | 0.021262 | 0.323219 | 0.630179 |
| 2243 | −0.0233 | −0.27218 | −0.27146 |
| 2245 | −0.02948 | 0.435608 | 0.648983 |
| 2246 | −0.01451 | −0.11772 | −0.40097 |
| 2247 | −0.01953 | −0.32074 | −0.89551 |
| 2248 | −0.012664 | 0.324801 | 0.485921 |
| 2249 | −0.11577 | −0.70415 | −1.88167 |

TABLE 1a-continued phase reporter genes

| SEQ ID NO | log(ratio) CP | log(ratio) AP | log(ratio) BC |
|---|---|---|---|
| 2250 | 0.012475 | −0.08448 | −0.52598 |
| 2251 | 0.019459 | 0.082497 | 0.306636 |
| 2254 | −0.01464 | 0.4015 | 0.607716 |
| 2255 | 0.008703 | −0.03485 | −0.2459 |
| 2256 | −0.00734 | −0.24854 | −0.35887 |
| 2257 | −0.1667 | −0.29214 | −1.57416 |
| 2258 | 0.025576 | 0.284406 | 0.328053 |
| 2259 | −0.04541 | −0.3858 | −1.56258 |
| 2260 | 0.001392 | 0.250803 | 0.374406 |
| 2261 | 0.009299 | −0.21002 | −0.19307 |
| 2262 | 0.018302 | 0.251187 | 0.347344 |
| 2263 | −0.02879 | −0.29245 | −0.45101 |
| 2264 | −0.01469 | 0.142428 | 0.400088 |
| 2265 | −0.05956 | −0.10194 | −1.14857 |
| 2267 | 0.018365 | 0.286151 | 0.448262 |
| 2268 | 0.018301 | 0.088642 | 0.351184 |
| 2270 | 0.016318 | 0.184584 | 0.437909 |
| 2271 | 0.00117 | −0.17535 | −0.18357 |
| 2272 | −0.0067 | 0.145926 | 0.465509 |
| 2273 | 0.028317 | 0.260572 | 0.407932 |
| 2274 | 0.003924 | 0.100185 | 0.394108 |
| 2275 | 0.001144 | −0.01617 | 0.237965 |
| 2276 | −0.00554 | −0.27487 | −0.4612 |
| 2277 | −0.05148 | −0.1106 | −1.37907 |
| 2278 | 0.000259 | 0.217995 | 0.369969 |
| 2279 | −0.00916 | −0.136 | −0.27663 |
| 2280 | 0.006631 | 0.197481 | 0.573742 |
| 2281 | 0.025366 | 0.076441 | −0.41989 |
| 2282 | 0.003573 | −0.28411 | −0.296893 |
| 2283 | 0.011297 | 0.42849 | 0.742061 |
| 2284 | −0.01898 | −0.2316 | −0.65533 |
| 2286 | −0.00426 | −0.361198 | −0.342302 |
| 2287 | 0.004729 | 0.137132 | 0.328942 |
| 2288 | 0.018171 | 0.241546 | 0.359732 |
| 2290 | −0.01784 | −0.18518 | −0.20255 |
| 2291 | −0.01003 | −0.11266 | −0.29419 |
| 2293 | 0.010189 | −0.1935 | −0.72632 |
| 2294 | −0.03967 | −0.08272 | −0.37749 |
| 2295 | −0.01802 | −0.14871 | −0.63321 |
| 2296 | −0.01662 | −0.15705 | −0.53086 |
| 2297 | 0.028114 | 0.118132 | 0.19296 |
| 2298 | −0.0099 | −0.20647 | −0.37635 |
| 2299 | −0.06665 | −0.49226 | −0.76252 |
| 2300 | 0.003024 | 0.185532 | 0.329792 |
| 2301 | 0.003459 | −0.09165 | −0.17224 |
| 2302 | 0.008627 | −0.135924 | −0.184813 |
| 2303 | 0.001354 | −0.20444 | −0.38761 |
| 2305 | −0.02601 | −0.27937 | −0.93622 |
| 2306 | −0.032 | −0.17657 | −0.40731 |
| 2307 | −0.02362 | −0.24769 | −0.48945 |
| 2308 | −0.01428 | −0.1252 | −0.56253 |
| 2309 | 0.004879 | −0.01626 | 0.177099 |
| 2310 | −0.001488 | −0.154965 | −0.151611 |
| 2311 | −0.0355 | −0.06494 | −0.81527 |
| 2314 | 0.000047 | 0.173299 | 0.33084 |
| 2315 | 0.014775 | −0.21485 | −0.26234 |
| 2316 | −0.0855 | −0.4418 | −1.05437 |
| 2317 | −0.1403 | −0.11166 | −1.30303 |
| 2318 | 0.019665 | 0.322236 | 0.461469 |
| 2319 | 0.00727 | −0.17689 | −0.17482 |
| 2321 | 0.029903 | −0.18599 | −0.1737 |
| 2322 | −0.01996 | −0.20753 | −0.47119 |
| 2323 | 0.019525 | 0.499532 | 0.706726 |
| 2324 | −0.00226 | −0.09615 | −0.26922 |
| 2325 | 0.002831 | −0.12896 | −0.40715 |
| 2326 | −0.03027 | −0.29217 | −0.52745 |
| 2327 | −0.03554 | −0.15001 | −0.44243 |
| 2328 | 0.027305 | 0.107061 | 0.404793 |
| 2330 | 0.002761 | 0.078152 | 0.232141 |
| 2331 | 0.014591 | −0.20659 | −0.24591 |
| 2332 | −0.01237 | −0.3604 | −0.96262 |
| 2333 | 0.003339 | −0.13529 | −0.30058 |
| 2334 | 0.020232 | 0.178617 | 0.405091 |
| 2335 | 0.010095 | 0.152031 | 0.299269 |
| 2336 | 0.018881 | 0.098289 | 0.233411 |
| 2337 | 0.01485 | 0.109005 | 0.284366 |
| 2338 | 0.014368 | 0.188275 | 0.327004 |
| 2339 | 0.015409 | 0.134288 | 0.185346 |
| 2340 | 0.00381 | 0.083288 | 0.228486 |
| 2341 | −0.00868 | 0.174526 | 0.205402 |
| 2342 | 0.002769 | 0.167636 | 0.260991 |
| 2343 | 0.023292 | 0.082431 | 0.207825 |
| 2344 | 0.009922 | 0.174544 | 0.389325 |
| 2345 | 0.028308 | 0.299421 | 0.363884 |
| 2346 | −0.05802 | −0.49477 | −0.53976 |
| 2347 | 0.006781 | −0.16619 | −0.50252 |
| 2348 | −0.00471 | −0.24265 | −0.40632 |
| 2349 | −0.00289 | −0.26804 | −0.24449 |
| 2350 | −0.00163 | −0.26011 | −0.6722 |
| 2351 | −0.01717 | −0.49896 | −0.45749 |
| 2352 | −0.03309 | −0.1127 | −0.78667 |
| 2353 | −0.01112 | −0.18403 | −0.67658 |
| 2355 | −0.05419 | −0.28594 | −1.00055 |
| 2357 | −0.00326 | −0.2309 | −0.30353 |
| 2358 | 0.001835 | −0.08573 | −0.21332 |
| 2359 | −0.01645 | −0.1167 | −0.28613 |
| 2360 | −0.01825 | −0.20883 | −0.34224 |
| 2361 | 0.005704 | −0.11607 | −0.17499 |
| 2362 | −0.01047 | 0.231999 | 0.357179 |
| 2363 | 0.010747 | 0.275006 | 0.341328 |
| 2364 | −0.00207 | −0.18193 | −0.15526 |
| 2365 | −0.0054 | −0.20264 | −0.3212 |
| 2366 | −0.00365 | 0.345983 | 0.585183 |
| 2367 | 0.00371 | 0.348181 | 0.574241 |
| 2368 | −0.00047 | −0.39854 | −0.27045 |
| 2369 | 0.004161 | −0.11105 | −0.25499 |
| 2370 | 0.009182 | −0.2079 | −0.21171 |
| 2371 | 0.005776 | −0.16574 | −0.17686 |
| 2373 | −0.07101 | −0.19618 | −1.27507 |
| 2374 | −0.05482 | −0.24994 | −1.2083 |
| 2375 | −0.08589 | −0.36391 | −1.39884 |
| 2376 | 0.012739 | 0.206079 | 0.359452 |
| 2377 | 0.011456 | −0.12574 | −0.42451 |
| 2378 | 0.011457 | 0.252312 | 0.495695 |
| 2379 | −0.00327 | −0.2122 | −0.37955 |
| 2380 | −0.01316 | −0.25034 | −0.60606 |
| 2381 | −0.01115 | −0.19235 | −0.40341 |
| 2382 | −0.12207 | −0.52644 | −1.56003 |
| 2383 | −0.06705 | −0.47182 | −1.61495 |
| 2384 | 0.006198 | 0.205257 | 0.192964 |
| 2385 | −0.01366 | −0.28913 | −0.30197 |
| 2386 | 0.003211 | −0.20733 | −0.22757 |
| 2388 | −0.057599 | 0.240909 | 0.4755 |
| 2389 | −0.01387 | −0.23521 | −0.40967 |
| 2390 | −0.00202 | −0.24353 | −0.61697 |
| 2391 | 0.00954 | 0.313285 | 0.540015 |
| 2392 | −0.00821 | −0.28209 | −0.34509 |
| 2393 | −0.01174 | −0.24409 | −0.30122 |
| 2394 | −0.0009 | −0.23828 | −0.28305 |
| 2395 | −0.00185 | −0.15898 | −0.18266 |
| 2396 | −0.02047 | −0.18068 | −0.39259 |
| 2397 | −0.01208 | −0.20406 | −0.25478 |
| 2398 | −0.01655 | −0.06001 | −0.57022 |
| 2399 | −0.02925 | −0.1465 | −0.59147 |
| 2400 | −0.0331 | −0.10996 | −0.63571 |
| 2401 | −0.06494 | 0.342079 | 0.465985 |
| 2402 | −0.04543 | −0.21281 | −0.34911 |
| 2403 | 0.01053 | 0.149484 | 0.288128 |
| 2404 | 0.008288 | −0.20655 | −0.46411 |
| 2405 | −0.00489 | 0.133801 | 0.312915 |
| 2407 | −0.02636 | −0.26027 | −0.34624 |
| 2408 | 0.019185 | 0.130116 | 0.27178 |
| 2409 | 0.020264 | 0.01922 | 0.337092 |
| 2410 | 0.031527 | 0.419581 | 0.586724 |
| 2411 | 0.014796 | 0.186449 | 0.312028 |
| 2412 | 0.014163 | 0.110452 | 0.254911 |
| 2413 | 0.020538 | 0.201187 | 0.42546 |
| 2414 | 0.01084 | 0.14581 | 0.272706 |
| 2415 | −0.01583 | 0.331777 | 0.392434 |
| 2416 | −0.026 | −0.20967 | −0.78121 |

TABLE 1a-continued phase reporter genes

| SEQ ID NO | log(ratio) CP | log(ratio) AP | log(ratio) BC |
|---|---|---|---|
| 2417 | 0.009603 | 0.134698 | 0.344874 |
| 2418 | 0.001308 | −0.26017 | −0.41484 |
| 2419 | 0.013034 | 0.147238 | 0.234368 |
| 2420 | −0.00937 | −0.22861 | −0.37108 |
| 2421 | 0.027995 | 0.500671 | 0.712713 |
| 2422 | −0.00456 | 0.06091 | 0.306779 |
| 2423 | −0.01058 | −0.10054 | −0.31111 |
| 2424 | 0.019249 | −0.14345 | −0.14736 |
| 2425 | −0.00553 | −0.21816 | −0.23095 |
| 2426 | 0.018803 | −0.12179 | −0.16992 |
| 2428 | 0.029088 | 0.15182 | 0.39338 |
| 2429 | −0.02133 | −0.10692 | −0.59333 |
| 2430 | −0.00858 | −0.14883 | −0.39404 |
| 2431 | 0.000421 | −0.20582 | −0.26891 |
| 2432 | 0.010577 | 0.080647 | 0.323731 |
| 2433 | 0.010272 | 0.158407 | 0.253436 |
| 2434 | 0.018304 | 0.091154 | 0.238737 |
| 2435 | −0.01327 | 0.215367 | 0.643105 |
| 2436 | −0.00898 | 0.396856 | 0.480941 |
| 2438 | 0.02318 | 0.143816 | 0.482143 |
| 2439 | 0.012843 | 0.100285 | 0.337322 |
| 2440 | 0.003224 | −0.22144 | −0.38004 |
| 2441 | −0.17071 | −0.64477 | −1.70673 |
| 2443 | −0.03906 | 0.097856 | −0.73832 |
| 2444 | −0.03501 | −0.31146 | −0.56481 |
| 2445 | −0.08669 | −0.23792 | −1.06465 |
| 2446 | 0.005175 | 0.027188 | 0.217852 |
| 2447 | −0.02276 | −0.37514 | −0.7337 |
| 2448 | −0.03247 | −0.26674 | −0.66752 |
| 2450 | −0.0089 | −0.1816 | −0.41721 |
| 2451 | −0.009 | −0.18197 | −0.25772 |
| 2452 | 0.011127 | 0.14173 | 0.594525 |
| 2453 | 0.010407 | 0.147058 | 0.493581 |
| 2455 | −0.03877 | −0.35242 | −0.72069 |
| 2456 | 0.016955 | 0.224789 | 0.295622 |
| 2457 | 0.014259 | 0.230541 | 0.457636 |
| 2458 | −0.01036 | 0.97751 | 0.84787 |
| 2459 | −0.00972 | −0.22179 | −0.27712 |
| 2460 | −0.01003 | 0.282259 | 0.249375 |
| 2461 | −0.00813 | −0.26674 | −0.38386 |
| 2462 | −0.04743 | −0.42331 | −1.04892 |
| 2463 | −0.01118 | −0.17632 | −0.38127 |
| 2464 | −0.01496 | 0.25609 | 0.530373 |
| 2465 | 0.015167 | 0.272307 | 0.486531 |
| 2466 | 0.007607 | 0.091023 | 0.24223 |
| 2467 | 0.001203 | −0.17614 | −0.21144 |
| 2468 | −0.0495 | −0.20539 | −1.03302 |
| 2470 | 0.011666 | −0.01179 | −0.39515 |
| 2471 | 0.007839 | 0.015293 | 0.179679 |
| 2472 | −0.0675 | −0.2604 | −0.77189 |
| 2473 | 0.042454 | 0.356955 | 0.52599 |
| 2474 | 0.024798 | 0.424526 | 0.622476 |
| 2475 | 0.017185 | 0.118985 | 0.272997 |
| 2476 | −0.00151 | −0.20843 | −0.26359 |
| 2477 | −0.03325 | −0.19374 | −0.70538 |
| 2478 | 0.000772 | 0.200976 | 0.23686 |
| 2479 | 0.009625 | −0.032207 | −0.206553 |
| 2480 | 0.034759 | 0.225437 | 0.487019 |
| 2481 | 0.022664 | 0.610916 | 0.667696 |
| 2482 | 0.005843 | 0.087991 | 0.267574 |
| 2483 | −0.0108 | −0.23961 | −0.27867 |
| 2484 | −0.0489 | −0.49706 | −0.74765 |
| 2485 | −0.00739 | −0.22778 | −0.26588 |
| 2486 | −0.02303 | −0.19453 | −0.90744 |
| 2487 | −0.0127 | −0.19671 | −0.27102 |
| 2488 | 0.00124 | 0.334635 | 0.409977 |
| 2489 | −0.03347 | 0.326986 | 0.48573 |
| 2490 | −0.00637 | −0.16367 | −0.29463 |
| 2491 | −0.04518 | −0.3492 | −1.29805 |
| 2493 | 0.053745 | 1.12642 | 0.94785 |
| 2494 | −0.03874 | −0.31269 | −0.93463 |
| 2495 | 0.023159 | −0.11675 | −0.103801 |
| 2496 | −0.04042 | −0.18134 | −0.32796 |
| 2497 | −0.00968 | −0.17688 | −0.31544 |
| 2498 | −0.00646 | −0.13239 | −0.27549 |
| 2499 | 0.020456 | −0.11915 | −0.20817 |
| 2500 | −0.00024 | 0.150011 | 0.281853 |
| 2501 | 0.002305 | −0.19 | −0.16291 |
| 2502 | −0.00389 | −0.26393 | −0.51363 |
| 2503 | 0.007055 | 0.226836 | 0.650437 |
| 2504 | −0.02326 | −0.21997 | −0.20391 |
| 2506 | 0.003697 | −0.17838 | −0.16412 |
| 2507 | 0.014856 | 0.211712 | 0.662258 |
| 2508 | 0.004992 | 0.206253 | 0.322137 |
| 2509 | −0.01335 | 0.387216 | 0.64411 |
| 2510 | 0.00376 | 0.176215 | 0.175013 |
| 2511 | 0.021121 | 0.250397 | 0.475791 |
| 2512 | −0.01114 | −0.14474 | −0.29232 |
| 2513 | −0.00899 | −0.26498 | −0.32929 |
| 2514 | −0.0094 | −0.33164 | −0.3425 |
| 2515 | 0.009736 | −0.12433 | −0.24292 |
| 2516 | 0.014748 | −0.14755 | −0.36336 |
| 2517 | −0.02821 | −0.14399 | −0.96724 |
| 2518 | 0.016951 | −0.22681 | −0.2849 |
| 2519 | 0.013879 | 0.04559 | 0.238972 |
| 2520 | 0.008005 | 0.120957 | 0.271537 |
| 2521 | 0.019315 | 0.19178 | 0.359679 |
| 2522 | −0.01642 | −0.25679 | −0.6551 |
| 2523 | 0.000814 | 0.14721 | 0.281618 |
| 2524 | 0.003431 | 0.108577 | 0.293128 |
| 2526 | −0.00756 | 0.381512 | 0.499936 |
| 2527 | 0.017397 | 0.16436 | 0.380404 |
| 2528 | −0.00472 | −0.14086 | −0.27949 |
| 2529 | −0.04997 | −0.30686 | −1.03052 |
| 2530 | 0.020347 | 0.425812 | 0.699923 |
| 2532 | −0.02576 | −0.1743 | −0.40075 |
| 2533 | 0.011399 | −0.11366 | −0.53325 |
| 2534 | 0.008381 | −0.17413 | −0.38127 |
| 2535 | −0.03843 | 0.32444 | 0.398745 |
| 2536 | 0.019072 | 0.11128 | 0.265768 |
| 2537 | 0.011658 | 0.086694 | 0.325898 |
| 2538 | 0.009353 | 0.095996 | 0.301137 |
| 2539 | 0.014166 | 0.245734 | 0.547442 |
| 2540 | 0.006622 | 0.02503 | −0.50418 |
| 2541 | 0.014146 | −0.23165 | −0.29847 |
| 2542 | −0.00111 | −0.13198 | −0.20208 |
| 2543 | 0.024546 | 0.156842 | 0.413413 |
| 2544 | 0.010614 | −0.2345 | −0.25904 |
| 2546 | 0.022578 | 0.352106 | 0.343754 |
| 2547 | 0.014781 | 0.184397 | 0.348549 |
| 2548 | 0.011386 | −0.1538 | −0.27843 |
| 2549 | −0.00098 | 0.337269 | 0.360711 |
| 2550 | −0.05955 | −0.38445 | −0.65242 |
| 2551 | −0.01004 | −0.23455 | −0.49484 |
| 2552 | −0.00126 | −0.1658 | −0.45861 |
| 2555 | −0.02678 | −0.35264 | −0.74733 |
| 2556 | −0.07595 | −0.25382 | −1.18748 |
| 2557 | 0.00079 | −0.15267 | −0.17722 |
| 2558 | 0.017602 | 0.483066 | 0.569061 |
| 2559 | −0.10296 | −0.5151 | −1.33311 |
| 2560 | −0.01213 | 0.652433 | 0.814574 |
| 2561 | 0.042592 | 0.904833 | 1.185076 |
| 2562 | 0.019606 | 0.558342 | 0.633058 |
| 2563 | 0.008532 | −0.26733 | −0.21859 |
| 2566 | −0.05012 | −0.11162 | −0.85316 |
| 2567 | 0.018774 | 0.481516 | 0.617251 |
| 2569 | 0.011241 | 0.158975 | 0.353304 |
| 2570 | 0.022175 | 0.237788 | 0.396769 |
| 2571 | 0.005227 | 0.271052 | 0.459074 |
| 2572 | −0.05856 | −0.07066 | −0.67025 |
| 2573 | 0.000905 | −0.23692 | −0.20779 |
| 2574 | −0.00505 | −0.27258 | −0.40155 |
| 2575 | 0.036113 | 0.950609 | 1.148166 |
| 2576 | 0.016198 | 0.298918 | 0.271315 |
| 2577 | 0.013361 | 0.513911 | 0.719117 |
| 2578 | −0.02544 | −0.03916 | −0.6724 |
| 2579 | 0.004507 | −0.02659 | −0.34807 |
| 2580 | 0.036264 | 0.330648 | 0.381713 |
| 2581 | 0.001592 | 0.132732 | 0.519435 |
| 2583 | 0.008092 | −0.22414 | −0.24833 |

TABLE 1a-continued phase reporter genes

| SEQ ID NO | log(ratio) CP | log(ratio) AP | log(ratio) BC |
|---|---|---|---|
| 2584 | −0.1018 | 0.310274 | 0.497463 |
| 2585 | −0.00552 | −0.23275 | −0.19769 |
| 2586 | −0.0004 | −0.26457 | −0.70305 |
| 2587 | 0.007071 | 0.108924 | 0.294335 |
| 2588 | −0.01101 | −0.26872 | −0.24312 |
| 2589 | 0.013947 | −0.18537 | −0.35969 |
| 2590 | −0.0019 | −0.15674 | −0.17527 |
| 2591 | −0.014377 | 0.016583 | 0.170925 |
| 2592 | 0.01295 | 0.153662 | 0.382013 |
| 2593 | 0.00262 | 0.15853 | 0.267567 |
| 2594 | −0.0291 | −0.1754 | −0.34028 |
| 2595 | −0.03633 | −0.1049 | −0.82392 |
| 2596 | 0.012658 | 0.185174 | 0.311561 |
| 2597 | −0.09052 | −0.0452 | −0.72876 |
| 2598 | −0.02908 | 0.32883 | 0.623743 |
| 2599 | 0.00495 | −0.09515 | −0.37573 |
| 2601 | −0.02013 | −0.22364 | −0.6205 |
| 2602 | −0.18084 | −0.4668 | −1.7534 |
| 2603 | 0.001916 | −0.23833 | −0.32446 |
| 2604 | 0.023943 | 0.186342 | 0.30044 |
| 2605 | 0.008612 | 0.06615 | 0.246228 |
| 2606 | −0.00227 | −0.0397 | −0.33125 |
| 2607 | −0.00624 | −0.32819 | −0.26536 |
| 2608 | 0.014148 | −0.24843 | −0.76695 |
| 2609 | −0.00987 | −0.34001 | −0.73479 |
| 2610 | −0.01228 | −0.31508 | −1.22943 |
| 2611 | 0.03185 | 0.253384 | 0.404518 |
| 2612 | −0.01704 | −0.22853 | −0.90805 |
| 2613 | 0.006249 | 0.351138 | 0.793232 |
| 2614 | 0.002701 | −0.14953 | −0.18679 |
| 2616 | 0.007045 | 0.206471 | 0.278793 |
| 2617 | −0.02856 | −0.17137 | −0.69373 |
| 2619 | 0.023946 | 0.166249 | 0.415608 |
| 2620 | 0.004685 | 0.148348 | 0.297014 |
| 2621 | −0.02346 | −0.27184 | −0.3663 |
| 2622 | −0.09931 | −0.49581 | −0.64319 |
| 2623 | 0.024583 | 0.186144 | 0.242691 |
| 2624 | −0.06684 | −0.27099 | −0.6539 |
| 2625 | 0.025326 | 0.154976 | 0.317266 |
| 2626 | −0.02775 | −0.27761 | −0.50705 |
| 2627 | −0.03352 | −0.39158 | −0.76481 |
| 2628 | −0.02107 | −0.1802 | −0.85878 |
| 2630 | −0.0145 | 0.445904 | 0.60602 |
| 2631 | −0.091338 | −0.170022 | −1.015137 |
| 2634 | −0.04639 | 0.107567 | −0.69859 |
| 2635 | −0.01869 | −0.18888 | −0.3205 |
| 2636 | 0.024358 | 0.031929 | 0.227966 |
| 2637 | −0.01386 | −0.33834 | −0.75396 |
| 2638 | −0.01211 | −0.17702 | −0.23493 |
| 2639 | −0.02916 | 0.328587 | 0.413999 |
| 2640 | 0.018657 | 0.669585 | 0.520168 |
| 2641 | 0.016961 | 0.220598 | 0.300294 |
| 2642 | −0.00515 | 0.176272 | 0.475424 |
| 2643 | 0.01932 | 0.259828 | 0.56853 |
| 2644 | −0.01792 | 0.218963 | 0.501686 |
| 2645 | 0.011227 | −0.21091 | −0.25874 |
| 2646 | 0.019195 | −0.10398 | −0.45649 |
| 2647 | −0.0711 | −0.32248 | −0.61665 |
| 2648 | −0.02232 | −0.1408 | −1.04953 |
| 2650 | −0.00213 | −0.15863 | −0.21538 |
| 2651 | −0.17163 | −0.67147 | −1.85184 |
| 2654 | −0.018035 | −0.080645 | −0.380195 |
| 2655 | −0.04895 | −0.36896 | −0.8315 |
| 2656 | −0.00118 | 0.147777 | 0.349123 |
| 2657 | 0.020622 | 0.557576 | 0.583467 |
| 2659 | −0.05906 | 0.270506 | 0.402215 |
| 2661 | −0.05978 | −0.38606 | −1.02253 |
| 2662 | 0.01439 | 0.12426 | 0.341247 |
| 2663 | 0.01138 | −0.25562 | −0.20867 |
| 2664 | −0.03397 | −0.32905 | −0.58159 |
| 2667 | −0.03061 | −0.21083 | −0.38691 |
| 2668 | −0.00183 | 0.090112 | 0.307248 |
| 2669 | −0.02595 | 0.224807 | 0.298468 |
| 2671 | 0.003312 | −0.18156 | −0.55449 |
| 2672 | 0.000228 | 0.079683 | 0.278216 |
| 2673 | −0.04497 | −0.28606 | −0.64299 |
| 2674 | 0.018508 | 0.287535 | 0.383835 |
| 2675 | −0.04517 | −0.10085 | −0.67471 |
| 2676 | 0.013043 | 0.142284 | 0.315904 |
| 2677 | 0.018862 | −0.11512 | −0.15632 |
| 2678 | −0.00649 | −0.24672 | −0.18736 |
| 2679 | 0.013145 | 0.076521 | 0.17363 |
| 2680 | −0.02291 | −0.26992 | −0.35545 |
| 2681 | −0.0172 | −0.1704 | −0.42603 |
| 2682 | 0.012919 | 0.300304 | 0.527116 |
| 2683 | −0.0369 | −0.31319 | −0.65633 |
| 2684 | −0.00078 | 0.032448 | 0.2162 |
| 2685 | 0.013214 | 0.285226 | 0.374245 |
| 2687 | 0.025124 | 0.864609 | 0.893988 |
| 2688 | 0.022706 | 0.231544 | 0.440474 |
| 2689 | 0.00576 | −0.18355 | −0.16193 |
| 2690 | −0.00758 | 0.123796 | 0.40387 |
| 2691 | −0.05617 | 0.002515 | −0.60603 |
| 2692 | 0.031066 | 0.189018 | 0.246415 |
| 2693 | 0.002933 | −0.23438 | −0.4387 |
| 2694 | 0.027455 | 0.106166 | 0.318291 |
| 2695 | −0.01234 | −0.15248 | −0.67434 |
| 2696 | 0.061699 | 0.295673 | 0.624181 |
| 2698 | −0.00845 | −0.11741 | −0.23264 |
| 2699 | 0.021373 | −0.029099 | −0.143444 |
| 2700 | 0.003899 | 0.202364 | 0.325023 |
| 2701 | −0.06426 | −0.22383 | −0.94704 |
| 2702 | 0.027532 | −0.22419 | −0.24666 |
| 2703 | −0.09451 | −0.3224 | −0.48286 |
| 2704 | 0.000312 | 0.276539 | 0.313776 |
| 2705 | −0.00553 | −0.17665 | −0.78496 |
| 2706 | 0.012238 | 0.141166 | 0.398436 |
| 2707 | −0.03874 | −0.38717 | −1.35269 |
| 2708 | −0.05333 | −0.23516 | −1.42802 |
| 2709 | −0.05484 | −0.22256 | −0.96516 |
| 2710 | −0.06505 | −0.20362 | −1.45088 |
| 2711 | −0.02591 | 0.38523 | 0.613117 |
| 2712 | 0.0251 | 0.302437 | 0.494124 |
| 2713 | −0.0261 | −0.41054 | −0.88489 |
| 2714 | −0.02071 | −0.19565 | −0.34923 |
| 2715 | 0.029005 | 0.222292 | 0.478244 |
| 2716 | 0.010292 | −0.22227 | −0.284 |
| 2717 | 0.005257 | −0.12139 | −0.20079 |
| 2718 | −0.03409 | −0.2738 | −0.56229 |
| 2719 | 0.009388 | 0.123603 | 0.419133 |
| 2720 | −0.00948 | −0.14352 | −0.23741 |
| 2721 | 0.016631 | 0.211659 | 0.358481 |
| 2722 | −0.05307 | −0.09342 | −0.65511 |
| 2723 | 0.004326 | 0.260434 | 0.307745 |
| 2724 | 0.0194 | −0.15387 | −0.15219 |
| 2725 | 0.026271 | 0.168512 | 0.372761 |
| 2726 | −0.02547 | −0.1861 | −0.35489 |
| 2727 | 0.016873 | 0.107248 | 0.26431 |
| 2728 | −0.00201 | 0.182489 | 0.329976 |
| 2729 | −0.00645 | −0.12001 | −0.3705 |
| 2730 | 0.014374 | 0.101214 | 0.221322 |
| 2731 | −0.03619 | −0.15552 | −0.40649 |
| 2732 | −0.00689 | −0.24428 | −0.19066 |
| 2733 | −0.00379 | 0.341142 | 0.650992 |
| 2735 | −0.0009 | 0.449456 | 0.411388 |
| 2736 | −0.00403 | −0.25021 | −0.30318 |
| 2737 | 0.014266 | −0.09848 | −0.52333 |
| 2738 | −0.00811 | 0.104495 | 0.296998 |
| 2740 | −0.0598 | −0.33464 | −0.83089 |
| 2741 | −0.00346 | −0.2422 | −0.21708 |
| 2742 | 0.020007 | 0.197874 | 0.487764 |
| 2743 | −0.04421 | −0.29753 | −0.39784 |
| 2744 | −0.05582 | −0.27547 | −1.41615 |
| 2745 | 0.008873 | 0.250221 | 0.303601 |
| 2746 | 0.009041 | −0.1964 | −0.19165 |
| 2747 | −0.04114 | −0.21991 | −0.46801 |
| 2748 | 0.002816 | 0.249459 | 0.415758 |
| 2749 | 0.023171 | 0.209957 | 0.427975 |
| 2750 | 0.007282 | −0.224306 | −0.335665 |
| 2751 | −0.00413 | −0.26488 | −0.60034 |

TABLE 1a-continued phase reporter genes

| SEQ ID NO | log(ratio) CP | log(ratio) AP | log(ratio) BC |
|---|---|---|---|
| 2752 | 0.00973 | −0.12429 | −0.19183 |
| 2753 | −0.04282 | −0.27188 | −0.62868 |
| 2754 | −0.02887 | −0.12252 | −0.93795 |
| 2755 | −0.00187 | −0.1844 | −0.22541 |
| 2757 | −0.004 | −0.26216 | −0.39487 |
| 2758 | 0.009176 | 0.189247 | 0.315972 |
| 2759 | −0.00615 | −0.12202 | −0.27257 |
| 2760 | −0.0351 | −0.19813 | −0.42283 |
| 2761 | 0.000833 | −0.08427 | −0.39287 |
| 2762 | −0.01219 | −0.19936 | −0.25954 |
| 2763 | −0.16163 | −0.53089 | −1.32781 |
| 2764 | 0.013124 | 0.261892 | 0.446384 |
| 2765 | 0.020137 | 0.220469 | 0.323365 |
| 2767 | −0.01952 | −0.20113 | −0.27321 |
| 2768 | 0.00059 | −0.35561 | −0.50506 |
| 2769 | −0.04199 | −0.22403 | −1.08327 |
| 2770 | 0.003148 | 0.296314 | 0.512703 |
| 2771 | 0.019729 | −0.14299 | −0.25548 |
| 2772 | −0.00232 | −0.29066 | −0.31836 |
| 2773 | −0.01355 | −0.29771 | −0.3058 |
| 2774 | 0.012705 | −0.1251 | −0.40659 |
| 2775 | 0.02941 | 0.143135 | 0.319784 |
| 2776 | −0.00825 | −0.32347 | −0.41417 |
| 2778 | 0.003568 | 0.244188 | 0.434806 |
| 2779 | 0.01616 | 0.307586 | 0.310784 |
| 2781 | −0.04576 | −0.29594 | −0.60485 |
| 2782 | −0.06077 | −0.54338 | −1.42013 |
| 2783 | 0.010678 | 0.338306 | 0.394351 |
| 2784 | −0.02934 | −0.20385 | −0.40511 |
| 2785 | −0.07145 | −0.36143 | −0.97853 |
| 2786 | 0.018898 | 0.206224 | 0.363663 |
| 2787 | −0.00883 | −0.18902 | −0.36709 |
| 2789 | −0.00572 | −0.13531 | −0.34873 |
| 2790 | −0.0735 | −0.23269 | −1.51143 |
| 2791 | −0.05897 | −0.30025 | −1.62166 |
| 2792 | −0.03988 | −0.11644 | −0.42741 |
| 2793 | 0.026639 | 0.376211 | 0.416832 |
| 2794 | −0.01133 | −0.14615 | −0.67707 |
| 2795 | −0.02513 | 0.030291 | 0.424639 |
| 2796 | 0.013267 | −0.13917 | −0.22175 |
| 2797 | 0.010593 | 0.091777 | 0.261145 |
| 2798 | 0.000403 | 0.325407 | 0.684848 |
| 2799 | 0.003311 | −0.10639 | −0.2131 |
| 2800 | −0.01114 | 0.384706 | 0.524091 |
| 2801 | −0.01057 | −0.16236 | −0.87468 |
| 2803 | −0.01069 | −0.168 | −0.21351 |
| 2804 | −0.03986 | −0.33729 | −1.21088 |
| 2805 | −0.16102 | −0.43208 | −1.59262 |
| 2806 | −0.03892 | −0.26461 | −0.61483 |
| 2808 | 0.006358 | 0.059824 | 0.374545 |
| 2809 | −0.01802 | −0.32733 | −1.1068 |
| 2810 | −0.04049 | −0.36347 | −0.78229 |
| 2811 | −0.0034 | −0.20011 | −0.27079 |
| 2812 | −0.00165 | −0.28443 | −0.40857 |
| 2813 | 0.003336 | 0.202659 | 0.191714 |
| 2814 | −0.06861 | −0.23165 | −0.65899 |
| 2815 | 0.006303 | 0.092394 | 0.150836 |
| 2816 | 0.026799 | 0.248992 | 0.3651 |
| 2817 | −0.02931 | −0.20321 | −0.5221 |
| 2818 | 0.006975 | −0.20782 | −0.31632 |
| 2819 | −0.0002 | −0.26998 | −0.26063 |
| 2820 | −0.0174 | −0.26042 | −0.23405 |
| 2821 | 0.000657 | 0.152248 | 0.27011 |
| 2822 | −0.00262 | −0.35167 | −0.69414 |
| 2823 | 0.014754 | 0.14847 | 0.37705 |
| 2824 | −0.03396 | −0.07618 | −0.82052 |
| 2826 | −0.05703 | −0.25432 | −0.56691 |
| 2827 | 0.012301 | 0.312566 | 0.576178 |
| 2829 | −0.00672 | −0.19801 | −0.27716 |
| 2831 | −0.00088 | 0.189713 | 0.324526 |
| 2832 | −0.00508 | −0.20367 | −0.33123 |
| 2833 | 0.003518 | 0.489011 | 0.758237 |
| 2834 | 0.015303 | 0.239528 | 0.376497 |
| 2835 | 0.010979 | −0.2097 | −0.26586 |
| 2836 | 0.012616 | 0.350884 | 0.408435 |
| 2837 | 0.007863 | −0.11288 | −0.34884 |
| 2838 | 0.023001 | 0.293605 | 0.483056 |
| 2839 | 0.015417 | 0.064353 | 0.2282 |
| 2840 | −0.01948 | −0.13793 | −0.41247 |
| 2841 | −0.00974 | −0.17467 | −0.75174 |
| 2843 | 0.00165 | −0.12552 | −0.39499 |
| 2845 | 0.002541 | −0.18358 | −0.2877 |
| 2846 | 0.010896 | 0.283179 | 0.41805 |
| 2847 | −0.06383 | −0.40518 | −0.50056 |
| 2848 | 0.019375 | 0.628886 | 1.042919 |
| 2849 | 0.022903 | 0.33319 | 0.62162 |
| 2850 | −0.00501 | −0.13298 | −0.32358 |
| 2851 | −0.02006 | −0.1888 | −0.22847 |
| 2852 | −0.00816 | 0.570671 | 0.605013 |
| 2853 | −0.01898 | −0.16103 | −0.47212 |
| 2854 | −0.02199 | −0.19576 | −0.45982 |
| 2855 | −0.06362 | −0.30184 | −0.53822 |
| 2856 | 0.004923 | −0.15456 | −0.46797 |
| 2857 | −0.0198 | −0.21892 | −0.59469 |
| 2858 | −0.0124 | −0.19867 | −0.31083 |
| 2859 | 0.004654 | 0.201306 | 0.353282 |
| 2860 | −0.08969 | −0.45642 | −1.76572 |
| 2861 | −0.00546 | −0.12932 | −0.33515 |
| 2864 | −0.03376 | 0.313327 | 0.572913 |
| 2865 | 0.002638 | −0.150304 | −0.265439 |
| 2866 | −0.00529 | −0.19319 | −0.2969 |
| 2867 | 0.017267 | −0.1494 | −0.39953 |
| 2868 | 0.012607 | 0.258503 | 0.505524 |
| 2869 | −0.01303 | −0.34736 | −0.3071 |
| 2870 | −0.0758 | −0.00667 | 0.407464 |
| 2871 | −0.02757 | −0.18451 | −0.36204 |
| 2872 | 0.003653 | −0.3916 | −1.17567 |
| 2873 | −0.07463 | −0.61553 | −1.83244 |
| 2874 | −0.01321 | −0.14784 | −0.23818 |
| 2875 | −0.03974 | −0.16305 | −0.63838 |
| 2876 | 0.012221 | 0.104016 | 0.446625 |
| 2877 | −0.01922 | −0.22468 | −0.38807 |
| 2878 | −0.07287 | −0.52202 | −0.5894 |
| 2880 | 0.02149 | 0.057175 | 0.317275 |
| 2881 | 0.005167 | 0.239014 | 0.443733 |
| 2882 | 0.012339 | −0.16847 | −0.21284 |
| 2883 | −0.01227 | −0.24525 | −0.29448 |
| 2884 | 0.017666 | 0.064075 | 0.296162 |
| 2885 | −0.0284 | −0.02721 | −0.33866 |
| 2886 | 0.002242 | 0.396169 | 0.43595 |
| 2887 | −0.04032 | −0.1874 | −0.6342 |
| 2888 | −0.00529 | −0.24167 | −0.50771 |
| 2889 | −0.0378 | 0.329727 | 0.581504 |
| 2890 | −0.039 | −0.01533 | −0.80769 |
| 2891 | −0.00543 | 0.424207 | 0.304193 |
| 2892 | −0.04168 | −0.21264 | −0.42487 |
| 2893 | −0.00635 | 0.375673 | 0.535129 |
| 2895 | 0.009807 | −0.19318 | −0.22205 |
| 2897 | 0.009273 | 0.253754 | 0.334453 |
| 2898 | 0.030219 | 0.153076 | 0.558065 |
| 2899 | −0.02054 | −0.14638 | −0.51145 |
| 2901 | −0.01498 | −0.36242 | −0.44772 |
| 2902 | −0.06741 | −0.31666 | −0.65795 |
| 2903 | 0.010507 | 0.451363 | 0.447662 |
| 2904 | 0.013115 | 0.232774 | 0.446862 |
| 2905 | −0.00359 | −0.22495 | −0.36185 |
| 2906 | −0.00018 | −0.26065 | −0.19921 |
| 2907 | −0.02028 | −0.24598 | −0.42818 |
| 2908 | 0.00381 | 0.125532 | 0.307017 |
| 2909 | 0.005915 | 0.176843 | 0.45916 |
| 2910 | −0.00569 | 0.22965 | 0.405174 |
| 2911 | 0.016355 | 0.163711 | 0.369321 |
| 2912 | −0.00538 | −0.19107 | −0.23922 |
| 2913 | 0.013008 | 0.254014 | 0.513203 |
| 2914 | 0.01723 | 0.496381 | 0.646589 |
| 2915 | −0.03446 | −0.34402 | −1.05461 |
| 2916 | −0.00461 | 0.581074 | 0.695351 |
| 2917 | 0.011926 | −0.12652 | −0.34612 |
| 2918 | 0.010433 | 0.207989 | 0.308376 |
| 2919 | 0.028863 | 0.435713 | 0.552442 |

TABLE 1a-continued phase reporter genes

| SEQ ID NO | log(ratio) CP | log(ratio) AP | log(ratio) BC |
|---|---|---|---|
| 2920 | 0.007439 | −0.18482 | −0.16052 |
| 2922 | −0.01718 | −0.19775 | −0.65873 |
| 2923 | −0.05394 | −0.35788 | −0.88723 |
| 2924 | 0.007022 | −0.22385 | −0.18795 |
| 2925 | 0.029336 | 0.168739 | 0.255306 |
| 2926 | 0.031202 | 0.330227 | 0.372451 |
| 2927 | −0.01184 | 0.183868 | 0.287134 |
| 2929 | −0.00998 | 0.206045 | 0.361514 |
| 2930 | 0.032851 | 0.36053 | 0.59029 |
| 2931 | 0.03576 | 0.422564 | 0.584013 |
| 2932 | 0.013186 | 0.292828 | 0.354684 |
| 2933 | −0.00303 | −0.16442 | −0.33499 |
| 2934 | 0.020398 | 0.227165 | 0.380774 |
| 2935 | 0.012185 | 0.267216 | 0.260173 |
| 2936 | 0.024484 | −0.182182 | −0.112346 |
| 2937 | −0.00041 | −0.14593 | −0.16658 |
| 2938 | 0.01805 | −0.289863 | −0.273244 |
| 2939 | −0.000081 | −0.14541 | −0.19003 |
| 2940 | −0.0187 | −0.15705 | −0.60162 |
| 2941 | −0.01398 | 0.655521 | 0.647436 |
| 2943 | −0.00569 | −0.16623 | −0.25745 |
| 2944 | 0.012097 | 0.286265 | 0.562572 |
| 2945 | −0.07967 | −0.44647 | −1.64456 |
| 2946 | 0.000761 | −0.27061 | −0.32913 |
| 2947 | −0.02328 | −0.22028 | −0.39793 |
| 2948 | −0.00453 | 0.182118 | 0.342159 |
| 2949 | 0.029301 | 0.206466 | 0.364179 |
| 2950 | −0.0834 | −0.04703 | −0.95656 |
| 2951 | −0.01477 | −0.39573 | −0.66505 |
| 2952 | −0.00559 | 0.359004 | 0.535031 |
| 2954 | 0.047932 | 0.458951 | 0.629917 |
| 2955 | 0.015137 | 0.108264 | 0.337985 |
| 2956 | −0.00029 | −0.20181 | −0.65127 |
| 2957 | −0.01247 | −0.38495 | −0.66139 |
| 2958 | −0.00978 | −0.09718 | −0.51105 |
| 2959 | −0.00342 | 0.334166 | 0.433225 |
| 2960 | −0.01243 | −0.20204 | −0.37004 |
| 2961 | −0.09822 | −0.34643 | −1.4707 |
| 2962 | −0.00298 | −0.24026 | −0.40109 |
| 2963 | 0.019065 | 0.320716 | 0.422334 |
| 2964 | 0.019559 | −0.127505 | −0.385534 |
| 2965 | 0.005619 | −0.12517 | −0.28633 |
| 2966 | −0.12764 | −0.3992 | −1.46573 |
| 2968 | −0.01383 | −0.19388 | −0.17913 |
| 2969 | −0.03538 | 0.380063 | 0.713857 |
| 2970 | 0.021643 | 0.147623 | 0.311466 |
| 2971 | 0.003622 | 0.164605 | 0.265753 |
| 2972 | −0.01341 | 0.324055 | 0.399054 |
| 2973 | −0.06397 | 0.820025 | 0.699994 |
| 2974 | −0.02648 | 0.015975 | 0.336295 |
| 2975 | −0.02356 | 0.009007 | −0.34984 |
| 2976 | −0.11295 | −0.04438 | −1.36305 |
| 2978 | −0.01266 | −0.08436 | −0.53058 |
| 2979 | −0.008 | −0.24206 | −0.43445 |
| 2981 | −0.018057 | −0.15181 | −0.335472 |
| 2982 | 0.004258 | −0.09973 | −0.27167 |
| 2983 | −0.01474 | −0.37219 | −0.71757 |
| 2985 | 0.009237 | −0.11864 | −0.13353 |
| 2986 | −0.00048 | −0.30194 | −0.26929 |
| 2987 | 0.008786 | −0.20533 | −0.19647 |
| 2988 | 0.006482 | −0.06617 | −0.16949 |
| 2990 | 0.033576 | −0.02725 | −0.33696 |
| 2991 | 0.003232 | 0.179589 | 0.438639 |
| 2992 | −0.01259 | −0.20203 | −0.34483 |
| 2993 | 0.003781 | −0.21029 | −0.29586 |
| 2995 | −0.0014 | −0.27584 | −0.52723 |
| 2996 | −0.02464 | −0.17473 | −0.45646 |
| 2997 | −0.03992 | −0.14858 | −0.38703 |
| 2998 | −0.00727 | −0.36316 | −0.78671 |
| 2999 | −0.03383 | −0.18387 | −0.48421 |
| 3000 | 0.003352 | −0.26397 | −0.26321 |
| 3001 | 0.017349 | 0.777388 | 0.865386 |
| 3002 | 0.000544 | −0.20052 | −0.32716 |
| 3004 | −0.004586 | 0.054952 | 0.213188 |
| 3005 | 0.018677 | 0.190854 | 0.301304 |
| 3006 | −0.04094 | 0.229519 | 0.365523 |
| 3007 | −0.02533 | 0.302681 | 0.363968 |
| 3008 | −0.06654 | −0.2406 | −1.30298 |
| 3009 | 0.005668 | −0.19868 | −0.2915 |
| 3010 | 0.015344 | 0.173643 | 0.274982 |
| 3011 | 0.018029 | 0.282402 | 0.404468 |
| 3012 | 0.014116 | 0.143182 | 0.239793 |
| 3013 | 0.01091 | 0.14319 | 0.275557 |
| 3014 | −0.00079 | −0.21327 | −0.31866 |
| 3016 | 0.009972 | 0.329868 | 0.407073 |
| 3017 | −0.00658 | 0.090007 | 0.363423 |
| 3018 | 0.020646 | 0.239536 | 0.423704 |
| 3021 | 0.01314 | 0.232275 | 0.427549 |
| 3022 | 0.015475 | −0.112142 | −0.208532 |
| 3023 | −0.04766 | −0.1538 | −0.51425 |
| 3024 | 0.02152 | 0.296087 | 0.358643 |
| 3025 | 0.003295 | 0.558697 | 0.573622 |
| 3026 | 0.008292 | 0.234595 | 0.361208 |
| 3028 | 0.019262 | 0.268167 | 0.275965 |
| 3030 | 0.018755 | −0.16557 | −0.51697 |
| 3031 | −0.03294 | −0.15371 | −0.37108 |
| 3032 | −0.00015 | −0.0984 | −0.37515 |
| 3033 | −0.00854 | 0.192989 | 0.744194 |
| 3034 | −0.00319 | −0.1583 | −0.21839 |
| 3035 | 0.009487 | 0.265706 | 0.432792 |
| 3036 | −0.03611 | −0.19937 | −0.47445 |
| 3037 | 0.001415 | 0.054528 | 0.288511 |
| 3038 | 0.019725 | 0.319022 | 0.505978 |
| 3039 | 0.016702 | 0.296182 | 0.401787 |
| 3041 | −0.13197 | −0.47988 | −0.61756 |
| 3042 | −0.00948 | −0.13928 | −0.35391 |
| 3043 | 0.014027 | 0.088353 | 0.352426 |
| 3044 | 0.01248 | 0.051055 | 0.236628 |
| 3045 | 0.010376 | 0.42896 | 0.48251 |
| 3046 | −0.00696 | −0.15996 | −0.52027 |
| 3049 | −0.03367 | −0.12396 | −0.57631 |
| 3050 | −0.02681 | −0.20596 | −0.40564 |
| 3052 | −0.00359 | 0.474485 | 0.835556 |
| 3053 | 0.003314 | −0.27792 | −0.49845 |
| 3054 | −0.03475 | −0.38399 | −0.699 |
| 3055 | 0.006903 | 0.020261 | 0.347157 |
| 3056 | 0.004746 | 0.104426 | 0.171269 |
| 3057 | 0.003378 | −0.17245 | −0.24436 |
| 3058 | 0.030441 | 0.218777 | 0.35783 |
| 3059 | 0.025041 | 0.359176 | 0.433728 |
| 3060 | 0.018098 | 0.183912 | 0.365828 |
| 3061 | −0.000034 | 0.158142 | 0.413032 |
| 3062 | 0.043079 | 0.333002 | 0.486674 |
| 3063 | −0.02076 | 0.281196 | 0.543021 |
| 3064 | −0.01183 | 0.365879 | 0.407261 |
| 3065 | 0.01381 | 0.515595 | 0.840889 |
| 3066 | 0.039271 | 0.251036 | 0.372893 |
| 3067 | −0.00589 | 0.34118 | 0.5276 |
| 3068 | −0.04032 | −0.327 | −1.00996 |
| 3069 | 0.003072 | −0.25928 | −0.24888 |
| 3070 | 0.010517 | 0.092918 | 0.229078 |
| 3071 | 0.014334 | 0.331022 | 0.401046 |
| 3072 | −0.01646 | −0.3282 | −0.53157 |
| 3073 | 0.003834 | −0.22565 | −0.23659 |
| 3074 | −0.01416 | 0.378092 | 0.508069 |
| 3076 | −0.05507 | −0.23452 | −0.94449 |
| 3077 | −0.00817 | −0.25111 | −0.46768 |
| 3078 | 0.030342 | 0.07799 | 0.27279 |
| 3079 | −0.04798 | −0.33419 | −0.70407 |
| 3080 | 0.016457 | 0.203479 | 0.448908 |
| 3081 | 0.013804 | 0.097869 | 0.251654 |
| 3082 | 0.01048 | 0.345172 | 0.502642 |
| 3083 | 0.02232 | 0.445002 | 0.489276 |
| 3084 | −0.00091 | 0.163135 | 0.29476 |
| 3085 | −0.007467 | −0.154645 | −0.263535 |
| 3086 | −0.01528 | −0.25361 | −0.45727 |
| 3087 | −0.05711 | −0.09675 | −0.64699 |
| 3088 | 0.002833 | −0.28011 | −0.60236 |
| 3089 | −0.05295 | −0.27133 | −0.54452 |
| 3090 | −0.0201 | 0.350037 | 0.527004 |

TABLE 1a-continued phase reporter genes

| SEQ ID NO | log(ratio) CP | log(ratio) AP | log(ratio) BC |
|---|---|---|---|
| 3091 | −0.00468 | −0.15449 | −0.19102 |
| 3092 | 0.020352 | 0.084201 | 0.343845 |
| 3094 | −0.01318 | −0.14226 | −0.56388 |
| 3096 | −0.05777 | −0.30537 | −0.73187 |
| 3098 | 0.008537 | 0.35688 | 0.501601 |
| 3099 | −0.02475 | −0.0732 | −0.57235 |
| 3100 | 0.01775 | −0.18804 | −0.1829 |
| 3101 | −0.02567 | 0.281101 | 0.427564 |
| 3102 | 0.004868 | 0.495821 | 0.596134 |
| 3104 | −0.01012 | −0.12775 | −0.32441 |
| 3105 | 0.019248 | 1.05839 | 1.040093 |
| 3106 | −0.00596 | 1.314136 | 0.790987 |
| 3107 | 0.013409 | 0.097176 | 0.266456 |
| 3108 | −0.04616 | −0.28704 | −1.18359 |
| 3109 | −0.01472 | 0.259879 | 0.488806 |
| 3110 | 0.027294 | 0.230358 | 0.282229 |
| 3111 | 0.006123 | 0.225982 | 0.387085 |
| 3112 | −0.02267 | −0.18104 | −0.63794 |
| 3113 | −0.06425 | −0.26503 | −1.07691 |
| 3114 | −0.0948 | −0.36956 | −1.23335 |
| 3115 | −0.04583 | −0.49382 | −1.20727 |
| 3116 | −0.02818 | 0.051385 | −0.87159 |
| 3117 | −0.0115 | −0.1814 | −0.91534 |
| 3118 | 0.001685 | −0.25086 | −0.39179 |
| 3119 | 0.027202 | 0.655798 | 0.733879 |
| 3120 | −0.05247 | −0.08431 | −1.52294 |
| 3121 | 0.013677 | 0.537147 | 0.803073 |
| 3122 | 0.014001 | −0.12847 | −0.15725 |
| 3123 | −0.00239 | −0.08607 | −0.23083 |
| 3124 | 0.01732 | 0.295697 | 0.377715 |
| 3125 | −0.03826 | −0.21146 | −0.75159 |
| 3126 | 0.008702 | −0.15491 | −0.13718 |
| 3127 | 0.012702 | 0.225601 | 0.233661 |
| 3128 | 0.013901 | 0.266571 | 0.402974 |
| 3129 | −0.04573 | −0.37916 | −0.44747 |
| 3130 | −0.00287 | −0.27159 | −0.33301 |
| 3131 | 0.000551 | 0.04502 | 0.307794 |
| 3132 | 0.010392 | −0.20774 | −0.49839 |
| 3133 | −0.01323 | 0.273843 | 0.458958 |
| 3134 | 0.020184 | −0.16107 | −0.29602 |
| 3135 | 0.031084 | 0.398481 | 0.627175 |
| 3137 | −0.01305 | −0.21173 | −0.24733 |
| 3138 | 0.018786 | −0.18142 | −0.31374 |
| 3139 | 0.0187 | −0.14742 | −0.20354 |
| 3140 | −0.05516 | −0.25108 | −0.54902 |
| 3141 | −0.0048 | −0.15275 | −0.22772 |
| 3142 | −0.0227 | 0.279196 | 0.57074 |
| 3143 | −0.00254 | 0.086809 | 0.312544 |
| 3144 | 0.048819 | 0.739425 | 0.999592 |
| 3146 | 0.017688 | 0.027596 | 0.258845 |
| 3147 | 0.0139 | 0.165954 | 0.388525 |
| 3148 | 0.006463 | −0.34808 | −0.55323 |
| 3150 | 0.001422 | 0.153264 | 0.273845 |
| 3151 | −0.06787 | −0.47637 | −0.95974 |
| 3152 | 0.007479 | 0.237146 | 0.532839 |
| 3153 | −0.07307 | −0.36885 | −1.34196 |
| 3154 | 0.010749 | 0.229279 | 0.471297 |
| 3155 | 0.010019 | −0.20671 | −0.21313 |
| 3156 | −0.13663 | −0.04778 | −0.90229 |
| 3157 | 0.011699 | 0.296588 | 0.437411 |
| 3158 | −0.01812 | 0.31905 | 0.709541 |
| 3159 | −0.03859 | −0.42023 | −0.82137 |
| 3160 | 0.007129 | −0.24125 | −0.25608 |
| 3161 | −0.00211 | −0.17613 | −0.25482 |
| 3162 | 0.013397 | 0.327107 | 0.44691 |
| 3163 | −0.02918 | −0.24804 | −0.32863 |
| 3164 | 0.007546 | −0.13599 | −0.30613 |
| 3165 | 0.007648 | 0.150129 | 0.320259 |
| 3166 | −0.00925 | 0.315041 | 0.37035 |
| 3167 | 0.008692 | −0.18589 | −0.13523 |
| 3168 | −0.01645 | −0.17733 | −0.32333 |
| 3169 | 0.005329 | 0.35599 | 0.501989 |
| 3170 | 0.00096 | −0.13687 | −0.27807 |
| 3171 | 0.025162 | 0.253505 | 0.432252 |
| 3173 | 0.008033 | −0.20975 | −0.20204 |
| 3174 | −0.00667 | 0.223581 | 0.432822 |
| 3175 | 0.012684 | −0.23036 | −0.37511 |
| 3176 | −0.0022 | −0.12761 | −0.24151 |
| 3177 | −0.00613 | −0.21416 | −0.82353 |
| 3179 | −0.02798 | −0.09902 | −0.37325 |
| 3180 | −0.06937 | −0.35675 | −0.45365 |
| 3182 | −0.00878 | −0.19553 | −0.43475 |
| 3184 | 0.014123 | 0.153714 | 0.27916 |
| 3185 | −0.011662 | 0.324166 | 0.476811 |
| 3186 | 0.003925 | 0.218641 | 0.416295 |
| 3187 | −0.0217 | −0.21766 | −0.35455 |
| 3188 | 0.009443 | −0.17399 | −0.30213 |
| 3189 | 0.013393 | 0.246228 | 0.329736 |
| 3190 | 0.009392 | 0.116617 | 0.226114 |
| 3192 | −0.00689 | −0.1435 | −0.38558 |
| 3193 | 0.023131 | 0.18765 | 0.363035 |
| 3194 | 0.021832 | 0.28794 | 0.602436 |
| 3195 | −0.00808 | −0.17928 | −0.32289 |
| 3197 | 0.000099 | −0.25158 | −0.42864 |
| 3198 | −0.00178 | −0.09534 | −0.36252 |
| 3199 | −0.0045 | −0.23936 | −0.24827 |
| 3200 | 0.021765 | −0.14444 | −0.32609 |
| 3201 | −0.00066 | −0.14665 | −0.23809 |
| 3202 | 0.01394 | −0.19605 | −0.17116 |
| 3203 | −0.06709 | −0.12779 | −1.0721 |
| 3204 | 0.009707 | 0.320008 | 0.353795 |
| 3205 | −0.00024 | −0.10284 | −0.47641 |
| 3206 | 0.008618 | 0.126478 | 0.216198 |
| 3207 | −0.01478 | −0.17977 | −0.3826 |
| 3208 | −0.05194 | −0.28887 | −0.3946 |
| 3209 | −0.0024 | 0.199106 | 0.306245 |
| 3210 | −0.01425 | −0.2533 | −0.25163 |
| 3211 | 0.030676 | 0.577209 | 0.827048 |
| 3212 | 0.037696 | 0.336772 | 0.428138 |
| 3213 | −0.07147 | −0.0399 | −0.75753 |
| 3214 | 0.016621 | 0.240182 | 0.550815 |
| 3215 | 0.00353 | −0.064073 | −0.167793 |
| 3216 | −0.00167 | 0.230487 | 0.379468 |
| 3217 | −0.02827 | 0.399071 | 0.4142 |
| 3218 | 0.01687 | −0.15702 | −0.15885 |
| 3219 | 0.000907 | 0.482855 | 0.58526 |
| 3220 | −0.00058 | −0.24158 | −0.57869 |
| 3221 | 0.039553 | 0.317784 | 0.425908 |
| 3223 | −0.00448 | 0.200852 | 0.355045 |
| 3224 | −0.03101 | −0.10041 | −0.40524 |
| 3225 | −0.00451 | −0.09154 | −0.54089 |
| 3226 | −0.00489 | −0.22115 | −0.26913 |
| 3227 | −0.12484 | −0.54845 | −1.51336 |
| 3228 | −0.00735 | −0.29045 | −0.36098 |
| 3229 | −0.01115 | −0.23759 | −0.36465 |
| 3230 | 0.004136 | −0.10636 | −0.26828 |
| 3231 | −0.01215 | −0.35269 | −0.32622 |
| 3232 | −0.07169 | −0.26568 | −1.35996 |
| 3233 | −0.05571 | −0.36337 | −0.81359 |
| 3235 | 0.010425 | 0.337272 | 0.565398 |
| 3236 | 0.001723 | −0.25054 | −0.37664 |
| 3237 | 0.021406 | 0.308215 | 0.560428 |
| 3238 | −0.00291 | 0.162478 | 0.27761 |
| 3242 | −0.0207 | −0.41811 | −0.88664 |
| 3243 | 0.023459 | 0.274922 | 0.428784 |
| 3244 | 0.014825 | 0.263294 | 0.424309 |
| 3245 | −0.039738 | −0.344767 | −0.512409 |
| 3246 | 0.043242 | 0.182842 | 0.296309 |
| 3247 | −0.03455 | −0.25575 | −1.18019 |
| 3248 | −0.03044 | −0.28089 | −0.44547 |
| 3249 | −0.07284 | −0.3393 | −0.7614 |
| 3250 | −0.0067 | −0.19891 | −0.62832 |
| 3251 | 0.008065 | 0.047397 | 0.270353 |
| 3252 | 0.034553 | 0.193119 | 0.226108 |
| 3253 | −0.01395 | −0.18672 | −0.25821 |
| 3255 | 0.002476 | 0.391998 | 0.537425 |
| 3256 | −0.02652 | 0.194728 | 0.377224 |
| 3257 | −0.00565 | 0.286285 | 0.430893 |
| 3258 | 0.034862 | 0.13289 | 0.229998 |
| 3259 | −0.00161 | −0.12845 | −0.28114 |

TABLE 1a-continued phase reporter genes

| SEQ ID NO | log(ratio) CP | log(ratio) AP | log(ratio) BC |
|---|---|---|---|
| 3260 | −0.00019 | −0.13256 | −0.19506 |
| 3261 | −0.00165 | 0.414438 | 0.576451 |
| 3262 | 0.000275 | 0.119938 | 0.380233 |
| 3264 | 0.015944 | 0.171496 | 0.373635 |
| 3265 | −0.10602 | 0.065469 | −0.96256 |
| 3266 | 0.007249 | −0.15939 | −0.15051 |
| 3268 | 0.035057 | 0.135511 | 0.350804 |
| 3269 | −0.00071 | −0.21354 | −0.32006 |
| 3270 | 0.009556 | −0.08782 | −0.20777 |
| 3271 | 0.037912 | 0.382912 | 0.606604 |
| 3273 | 0.030081 | 0.092024 | 0.24176 |
| 3274 | −0.03181 | −0.19188 | −0.65311 |
| 3275 | −0.02899 | −0.26298 | −0.5252 |
| 3276 | −0.00612 | −0.239 | −0.25723 |
| 3277 | −0.03396 | −0.36011 | −0.97902 |
| 3278 | 0.005417 | −0.22054 | −0.27988 |
| 3279 | 0.00421 | 0.241544 | 0.337383 |
| 3280 | −0.04008 | −0.24002 | −0.49352 |
| 3281 | 0.011397 | −0.05727 | −0.21139 |
| 3282 | −0.00307 | 0.438222 | 0.645157 |
| 3283 | 0.015044 | −0.17112 | −0.17976 |
| 3285 | −0.02359 | 0.120369 | 0.368806 |
| 3286 | −0.01503 | −0.14384 | −0.33677 |
| 3287 | 0.03036 | 0.169511 | 0.318019 |
| 3288 | 0.000511 | −0.27843 | −0.25826 |
| 3289 | −0.03333 | −0.14182 | −0.53166 |
| 3290 | −0.01495 | −0.15518 | −0.42982 |
| 3291 | −0.00431 | 0.276152 | 0.455389 |
| 3292 | 0.029258 | 0.154612 | 0.311869 |
| 3293 | −0.02497 | −0.3162 | −0.63241 |
| 3294 | 0.008826 | 0.193775 | 0.327272 |
| 3295 | 0.01108 | 0.290689 | 0.469514 |
| 3296 | −0.01098 | −0.19785 | −0.29746 |
| 3297 | 0.002553 | 0.156526 | 0.384026 |
| 3298 | 0.002543 | 0.517046 | 0.535246 |
| 3299 | 0.021292 | −0.25826 | −0.46401 |
| 3300 | 0.05617 | 0.786871 | 0.883872 |
| 3301 | 0.007309 | 0.342597 | 0.387715 |
| 3302 | 0.021437 | 0.058026 | 0.30369 |
| 3303 | 0.026965 | 0.153504 | 0.312512 |
| 3304 | 0.030794 | 0.465812 | 0.665546 |
| 3305 | −0.00064 | −0.24084 | −0.3902 |
| 3306 | 0.014218 | 0.323398 | 0.507924 |
| 3307 | −0.00603 | −0.16018 | −0.25578 |
| 3308 | 0.027336 | 0.142909 | 0.417948 |
| 3309 | 0.021253 | 0.359649 | 0.534265 |
| 3310 | 0.01583 | 0.214567 | 0.352709 |
| 3311 | 0.004663 | 0.246844 | 0.433798 |
| 3313 | 0.012263 | 0.09774 | 0.259147 |
| 3314 | −0.01847 | −0.18197 | −0.3045 |
| 3315 | −0.01891 | −0.12996 | −0.51138 |
| 3316 | 0.012776 | −0.09152 | −0.12242 |
| 3318 | −0.01352 | −0.20692 | −0.49824 |
| 3319 | −0.01725 | −0.13233 | −0.3414 |
| 3320 | 0.005316 | 0.205002 | 0.321762 |
| 3321 | −0.02382 | −0.28781 | −0.38713 |
| 3322 | 0.019935 | −0.03942 | −0.12199 |
| 3323 | −0.03422 | −0.20408 | −1.174 |
| 3325 | 0.01035 | 0.208977 | 0.259191 |
| 3326 | 0.009919 | 0.487312 | 0.798474 |
| 3327 | 0.032358 | 0.351412 | 0.539655 |
| 3328 | −0.001545 | 0.072595 | 0.2077 |
| 3329 | −0.01033 | 0.298093 | 0.369777 |
| 3330 | −0.01145 | −0.26775 | −0.30683 |
| 3331 | 0.02103 | 0.293852 | 0.514689 |
| 3332 | −0.01512 | −0.05284 | 0.209339 |
| 3333 | 0.007594 | 0.149651 | 0.210803 |
| 3335 | −0.01696 | −0.25564 | −0.31549 |
| 3336 | 0.003874 | 0.1967 | 0.309171 |
| 3337 | 0.002692 | 0.239237 | 0.224774 |
| 3338 | −0.05145 | −0.42643 | −1.10198 |
| 3340 | −0.01922 | 0.312048 | 0.519411 |
| 3341 | −0.01633 | −0.29083 | −0.71715 |
| 3343 | 0.014905 | 0.193205 | 0.303607 |
| 3344 | −0.04371 | −0.17744 | −0.57694 |
| 3345 | −0.01708 | −0.17088 | −0.32927 |
| 3346 | 0.005582 | −0.18765 | −0.12004 |
| 3347 | 0.006103 | 0.306487 | 0.481478 |
| 3348 | 0.011207 | 0.246771 | 0.473469 |
| 3349 | −0.05596 | 0.053807 | −0.82774 |
| 3350 | 0.003028 | −0.26366 | −0.25487 |
| 3351 | 0.000215 | 0.420167 | 0.702344 |
| 3352 | −0.00142 | −0.2055 | −0.20167 |
| 3353 | 0.03597 | 0.319369 | 0.40673 |
| 3354 | 0.019053 | 0.29334 | 0.646468 |
| 3355 | −0.03285 | 0.140238 | 0.282499 |
| 3356 | −0.02039 | −0.31003 | −0.40374 |
| 3357 | −0.00365 | −0.26832 | −0.34539 |
| 3358 | −0.00683 | −0.1512 | −0.16026 |
| 3359 | 0.002591 | −0.19241 | −0.21712 |
| 3361 | 0.002381 | −0.16775 | −0.38488 |
| 3362 | −0.02798 | 0.001446 | −0.73588 |
| 3363 | 0.002006 | 0.073507 | 0.245698 |
| 3365 | 0.012282 | −0.08127 | −0.28952 |
| 3366 | −0.01316 | 0.491464 | 0.53771 |
| 3367 | 0.022913 | 0.243205 | 0.335408 |
| 3368 | 0.021086 | 0.216026 | 0.376684 |
| 3369 | −0.01697 | 0.619062 | 0.912489 |
| 3371 | −0.04089 | −0.35226 | −0.81703 |
| 3372 | 0.002305 | −0.13597 | −0.28332 |
| 3374 | −0.00085 | 0.355165 | 0.509894 |
| 3375 | 0.015607 | 0.264197 | 0.386962 |
| 3376 | 0.001514 | −0.16232 | −0.348 |
| 3377 | 0.010534 | 0.326794 | 0.48668 |
| 3379 | 0.001519 | 0.223336 | 0.462128 |
| 3380 | −0.012204 | −0.399725 | −0.454969 |
| 3381 | 0.003004 | 0.206857 | 0.518479 |
| 3382 | −0.04527 | −0.47572 | −0.79767 |
| 3383 | −0.00646 | −0.09346 | −0.33707 |
| 3384 | 0.010745 | 0.191902 | 0.707442 |
| 3385 | 0.003127 | 0.669957 | 0.777601 |
| 3386 | −0.0023 | −0.36617 | −0.46444 |
| 3387 | 0.007518 | 0.062612 | 0.32726 |
| 3388 | −0.0124 | 0.343569 | 0.490181 |
| 3390 | 0.018599 | 0.528533 | 0.889139 |
| 3391 | −0.03171 | −0.31391 | −1.21351 |
| 3392 | 0.019031 | 0.615219 | 0.758501 |
| 3393 | −0.04515 | −0.24606 | −0.85083 |
| 3394 | 0.014115 | 0.303657 | 0.422743 |
| 3395 | −0.006382 | −0.249059 | −0.201365 |
| 3397 | 0.014566 | 0.403164 | 0.502395 |
| 3399 | 0.006008 | 0.284452 | 0.430425 |
| 3401 | 0.013182 | 0.248262 | 0.463944 |
| 3402 | −0.084896 | 0.054938 | 0.463716 |
| 3403 | −0.02621 | −0.10465 | −0.3679 |
| 3404 | 0.030746 | 0.893767 | 0.896016 |
| 3405 | 0.020912 | −0.17105 | −0.16812 |
| 3406 | 0.011106 | 0.148178 | 0.436104 |
| 3407 | 0.000072 | −0.19676 | −0.13479 |
| 3408 | 0.011766 | 0.125037 | 0.384578 |
| 3409 | 0.003489 | 0.467613 | 0.591721 |
| 3410 | −0.01813 | −0.21229 | −0.5838 |
| 3411 | 0.018402 | 0.166256 | 0.319418 |
| 3412 | −0.0302 | −0.11487 | −0.6944 |
| 3413 | 0.008529 | 0.232717 | 0.266649 |
| 3414 | −0.03538 | −0.37811 | −0.82578 |
| 3415 | −0.04675 | −0.1464 | −0.87392 |
| 3416 | −0.04048 | −0.14832 | −0.3646 |
| 3417 | −0.04323 | −0.2426 | −0.65641 |
| 3418 | 0.016338 | 0.36836 | 0.506737 |
| 3419 | −0.03218 | −0.19306 | −0.62874 |
| 3420 | −0.02344 | −0.31573 | −0.63395 |
| 3420 | −0.000395 | −0.09677 | −0.20635 |
| 3421 | 0.001699 | 0.152819 | 0.361065 |
| 3422 | −0.02327 | −0.30397 | −0.58284 |
| 3423 | 0.018063 | 0.168456 | 0.36742 |
| 3424 | 0.001417 | 0.46457 | 0.544312 |
| 3425 | 0.017197 | 0.084069 | 0.236774 |
| 3426 | −0.0143 | −0.415 | −0.49023 |
| 3427 | −0.00826 | 0.011692 | 0.397204 |

TABLE 1a-continued phase reporter genes

| SEQ ID NO | log(ratio) CP | log(ratio) AP | log(ratio) BC |
|---|---|---|---|
| 3429 | 0.011585 | −0.21061 | −0.19135 |
| 3430 | −0.00389 | 0.25529 | 0.417486 |
| 3431 | 0.018041 | 0.116379 | 0.701201 |
| 3432 | 0.001096 | 0.243969 | 0.349062 |
| 3434 | 0.010097 | 0.107082 | 0.280805 |
| 3435 | 0.000005 | −0.20201 | −0.33312 |
| 3436 | 0.003803 | 0.238508 | 0.330679 |
| 3437 | 0.018084 | 0.389001 | 0.459152 |
| 3438 | 0.026842 | 0.293859 | 0.578822 |
| 3439 | 0.000424 | −0.28683 | −0.33506 |
| 3440 | 0.024002 | 0.306765 | 0.399311 |
| 3441 | 0.028082 | 0.048887 | 0.274704 |
| 3442 | 0.020809 | 0.300973 | 0.444948 |
| 3443 | −0.00612 | −0.26467 | −0.21439 |
| 3444 | 0.005934 | 0.221996 | 0.392987 |
| 3445 | −0.026 | −0.24664 | −0.40373 |
| 3446 | −0.01545 | −0.1622 | −0.53241 |
| 3447 | −0.01916 | 0.631321 | 1.046904 |
| 3448 | 0.004799 | −0.02619 | 0.261509 |
| 3449 | −0.00256 | 0.271647 | 0.610646 |
| 3450 | −0.00687 | −0.23718 | −0.83676 |
| 3451 | −0.04042 | −0.2342 | −0.49859 |
| 3452 | −0.00695 | 0.637148 | 0.904218 |
| 3453 | 0.012065 | 0.271877 | 0.408868 |
| 3454 | 0.013156 | 0.316884 | 0.467694 |
| 3455 | 0.002033 | 0.38549 | 0.523872 |
| 3457 | −0.23356 | −0.34986 | −1.48765 |
| 3458 | 0.004219 | 0.23896 | 0.416452 |
| 3459 | −0.00864 | −0.25095 | −0.49658 |
| 3460 | 0.019951 | 0.179862 | 0.292042 |
| 3461 | −0.05881 | −0.35086 | −0.54357 |
| 3463 | −0.00204 | 0.201464 | 0.238508 |
| 3464 | 0.024733 | 0.165091 | 0.289928 |
| 3465 | 0.002946 | 0.382687 | 0.547726 |
| 3466 | −0.03176 | −0.33056 | −0.31774 |
| 3467 | −0.00756 | 0.006983 | 0.307409 |
| 3468 | 0.023128 | 0.58833 | 0.543947 |
| 3469 | −0.00921 | −0.47814 | −0.3895 |
| 3470 | 0.021508 | 0.317946 | 0.743355 |
| 3471 | 0.014745 | −0.23137 | −0.2137 |
| 3472 | −0.07754 | −0.54498 | −0.58848 |
| 3473 | 0.010256 | 0.201012 | 0.503233 |
| 3474 | −0.01069 | −0.31679 | −1.24154 |
| 3475 | 0.004935 | −0.18108 | −0.24328 |
| 3477 | −0.007804 | −0.012007 | 0.180183 |
| 3478 | 0.007381 | −0.1484 | −0.15469 |
| 3480 | 0.008199 | 0.205783 | 0.335461 |
| 3481 | −0.00422 | 0.122569 | 0.420977 |
| 3483 | 0.027251 | 0.085133 | 0.267879 |
| 3484 | 0.006308 | 0.109444 | 0.315838 |
| 3485 | −0.00387 | −0.13886 | −0.20696 |
| 3486 | 0.01401 | 0.210819 | 0.385992 |
| 3487 | 0.030819 | 0.242769 | 0.503033 |
| 3488 | 0.029445 | 0.142119 | 0.279823 |
| 3489 | 0.027898 | 0.196172 | 0.331849 |
| 3490 | −0.0195 | −0.19389 | −0.55753 |
| 3491 | 0.011353 | 0.138351 | 0.237797 |
| 3492 | 0.007425 | 0.220427 | 0.372178 |
| 3493 | −0.03338 | −0.2384 | −0.51351 |
| 3494 | −0.02411 | −0.01836 | −0.49786 |
| 3495 | 0.013676 | 0.227614 | 0.406301 |
| 3496 | −0.078914 | 0.88838 | 0.619244 |
| 3497 | 0.004864 | 0.255284 | 0.427085 |
| 3498 | 0.010062 | 0.153347 | 0.345814 |
| 3499 | 0.005249 | 0.285996 | 0.502303 |
| 3500 | 0.028984 | 0.213153 | 0.331039 |
| 3501 | 0.015277 | 0.051125 | 0.262262 |
| 3502 | −0.00541 | −0.23659 | −0.41906 |
| 3503 | 0.005518 | 0.253884 | 0.276558 |
| 3504 | −0.01431 | −0.24218 | −0.43976 |
| 3505 | 0.006567 | 0.130584 | 0.331984 |
| 3506 | −0.00084 | 0.057802 | 0.245983 |
| 3507 | 0.018668 | 0.097833 | 0.194468 |
| 3508 | 0.016448 | 0.115095 | 0.227688 |
| 3509 | 0.013763 | 0.120072 | 0.2309 |
| 3510 | −0.00176 | 0.172136 | 0.392661 |
| 3511 | 0.033154 | 0.422828 | 0.502533 |
| 3512 | 0.019004 | 0.260874 | 0.605656 |
| 3513 | 0.00474 | 0.123786 | 0.272245 |
| 3515 | 0.003764 | 0.25854 | 0.35417 |
| 3516 | 0.006238 | −0.19753 | −0.1929 |
| 3517 | 0.00654 | 0.031032 | 0.211139 |
| 3518 | 0.007711 | 0.025393 | 0.337297 |
| 3519 | 0.021036 | 0.127258 | 0.316529 |
| 3520 | −0.01732 | −0.17969 | −1.05816 |
| 3521 | −0.03832 | −0.14892 | −0.64816 |
| 3522 | 0.002699 | 0.336047 | 0.755432 |
| 3523 | 0.0272 | 0.063065 | 0.326339 |
| 3524 | 0.007645 | −0.13807 | −0.11901 |
| 3525 | −0.0046 | 0.114568 | 0.217153 |
| 3526 | −0.00152 | −0.26116 | −0.28321 |
| 3527 | −0.02135 | −0.26583 | −0.57971 |
| 3528 | 0.025288 | 0.347945 | 0.459399 |
| 3529 | −0.06764 | −0.29288 | −0.81872 |
| 3530 | 0.021277 | 0.154993 | 0.324106 |
| 3531 | −0.000032 | 0.213466 | 0.316182 |
| 3532 | −0.02307 | 0.383006 | 0.430598 |
| 3534 | 0.006069 | 0.248446 | 0.367867 |
| 3535 | −0.01309 | −0.25375 | −0.68693 |
| 3536 | 0.014569 | 0.235339 | 0.390802 |
| 3537 | 0.008394 | 0.36569 | 0.441899 |
| 3539 | 0.029654 | 0.190536 | 0.223447 |
| 3540 | 0.022659 | 0.287814 | 0.460905 |
| 3541 | −0.0021 | 0.170309 | 0.289484 |
| 3542 | −0.01138 | −0.18146 | −0.32578 |
| 3543 | −0.01974 | −0.2489 | −0.27214 |
| 3544 | 0.027074 | 0.424713 | 0.675614 |
| 3545 | −0.07683 | −0.51183 | −1.36912 |
| 3547 | 0.000021 | 0.094057 | 0.223268 |
| 3548 | 0.011955 | 0.28919 | 0.485465 |
| 3549 | 0.023904 | 0.428122 | 0.680776 |
| 3550 | −0.03893 | −0.19043 | −0.68542 |
| 3551 | −0.07238 | −0.3147 | −1.46004 |
| 3552 | 0.015569 | 0.282794 | 0.347364 |
| 3553 | −0.00688 | 0.272823 | 0.325358 |
| 3556 | 0.04665 | 0.338627 | 0.457554 |
| 3557 | 0.014913 | 0.201938 | 0.4141 |
| 3558 | 0.032499 | 0.074678 | 0.253153 |
| 3559 | 0.008088 | 0.301892 | 0.453923 |
| 3560 | 0.004516 | 0.219196 | 0.385653 |
| 3561 | −0.00872 | −0.14402 | −0.3015 |
| 3562 | 0.011229 | 0.19481 | 0.270765 |
| 3563 | 0.002252 | 0.197059 | 0.467898 |
| 3564 | 0.004196 | −0.17839 | −0.35812 |
| 3565 | 0.005919 | 0.433496 | 0.704711 |
| 3566 | 0.014141 | 0.259842 | 0.625664 |
| 3567 | 0.002687 | −0.07275 | −0.16865 |
| 3568 | 0.019386 | 0.180756 | 0.320826 |
| 3569 | 0.008055 | 0.236448 | 0.463364 |
| 3570 | −0.00885 | −0.19005 | −0.18943 |
| 3571 | −0.01066 | −0.2524 | −0.31281 |
| 3572 | 0.003586 | 0.175294 | 0.33668 |
| 3573 | 0.003077 | −0.16699 | −0.2679 |
| 3574 | 0.010204 | −0.24174 | −0.21023 |
| 3575 | −0.01722 | −0.23788 | −0.5273 |
| 3576 | −0.00986 | −0.15833 | −0.35006 |
| 3577 | 0.002417 | 0.115933 | 0.275389 |
| 3578 | 0.01931 | 0.128265 | 0.257442 |
| 3579 | −0.00892 | −0.21633 | −0.26341 |
| 3580 | −0.00471 | −0.23215 | −0.4848 |
| 3581 | 0.020012 | −0.19936 | −0.17456 |
| 3582 | −0.03815 | −0.31028 | −0.83405 |
| 3583 | 0.050287 | −0.01954 | 0.220994 |
| 3584 | −0.00585 | −0.12787 | −0.3086 |
| 3585 | −0.00877 | 0.285035 | 0.313925 |
| 3586 | 0.023951 | 0.461968 | 0.522236 |
| 3587 | −0.03648 | −0.06649 | −0.96644 |
| 3588 | −0.0798 | −0.35864 | −0.6144.4 |
| 3589 | −0.01895 | −0.18531 | −0.59784 |
| 3590 | −0.00434 | −0.0927 | −0.57452 |

TABLE 1a-continued phase reporter genes

| SEQ ID NO | log(ratio) CP | log(ratio) AP | log(ratio) BC |
|---|---|---|---|
| 3591 | −0.01872 | −0.15803 | −0.39983 |
| 3592 | 0.034991 | 0.443566 | 0.697839 |
| 3593 | 0.003399 | −0.19622 | −0.33779 |
| 3594 | −0.00647 | −0.26511 | −0.28231 |
| 3595 | 0.02467 | 0.206796 | 0.445373 |
| 3596 | −0.05031 | −0.1575 | −0.48587 |
| 3597 | 0.01621 | −0.09026 | −0.15802 |
| 3598 | 0.012908 | −0.04883 | −0.1707 |
| 3599 | −0.00487 | −0.18513 | −0.31987 |
| 3600 | −0.00359 | −0.15119 | −0.29052 |
| 3601 | −0.0151 | −0.13785 | −0.44486 |
| 3602 | −0.0169 | −0.22645 | −0.42297 |
| 3603 | 0.005186 | −0.17402 | −0.16865 |
| 3604 | −0.05188 | 0.315535 | 0.632687 |
| 3605 | 0.023942 | 0.83018 | 0.88166 |
| 3606 | 0.025262 | 0.245762 | 0.342364 |
| 3607 | 0.011981 | −0.24067 | −0.45907 |
| 3608 | 0.00673 | 0.18853 | 0.415095 |
| 3609 | −0.01799 | −0.22257 | −0.34049 |
| 3610 | −0.01097 | −0.04613 | −0.41743 |
| 3612 | −0.01484 | −0.1804 | −0.4596 |
| 3613 | 0.000939 | 0.263793 | 0.678549 |
| 3614 | 0.006779 | −0.2545 | −0.29857 |
| 3615 | 0.015733 | 0.199486 | 0.348857 |
| 3616 | 0.027123 | 0.254658 | 0.40739 |
| 3617 | −0.02985 | −0.1815 | −0.3909 |
| 3618 | −0.05222 | −0.31387 | −0.6686 |
| 3619 | 0.012011 | 0.093853 | 0.436918 |
| 3621 | −0.03416 | −0.08213 | −0.7659 |
| 3622 | 0.012578 | −0.13075 | −0.23829 |
| 3623 | −0.000007 | 0.238639 | 0.514736 |
| 3624 | −0.01407 | −0.01854 | −0.6361 |
| 3625 | 0.03931 | 0.356907 | 0.463023 |
| 3626 | 0.018908 | 0.155317 | 0.368218 |
| 3627 | −0.018961 | −0.122255 | −0.455286 |
| 3628 | 0.014716 | 0.206784 | 0.434224 |
| 3629 | −0.07553 | −0.33141 | −0.9787 |
| 3630 | 0.015157 | 0.273984 | 0.247117 |
| 3631 | −0.00033 | 0.200936 | 0.41693 |
| 3633 | 0.007665 | 0.242867 | 0.368278 |
| 3634 | 0.009517 | 0.749121 | 0.730716 |
| 3635 | −0.00042 | −0.03395 | −0.27982 |
| 3636 | 0.014869 | 0.177299 | 0.385549 |
| 3637 | −0.00089 | 0.343397 | 0.523406 |
| 3638 | −0.01318 | −0.24177 | −0.26026 |
| 3639 | 0.015299 | 0.166454 | 0.312326 |
| 3641 | −0.02405 | −0.22617 | −0.36482 |
| 3643 | −0.01067 | −0.22275 | −0.30837 |
| 3644 | 0.015624 | 0.272495 | 0.42811 |
| 3645 | 0.02679 | 0.139602 | 0.304642 |
| 3647 | 0.016106 | −0.23904 | −0.34971 |
| 3648 | −0.00785 | 0.415134 | 0.576215 |
| 3649 | −0.03814 | −0.24153 | −0.62728 |
| 3651 | −0.00168 | 0.178946 | 0.296663 |
| 3652 | 0.005417 | 0.201231 | 0.293373 |
| 3653 | 0.020992 | 0.098499 | 0.323563 |
| 3654 | 0.009897 | 0.171846 | 0.304385 |
| 3655 | −0.009543 | −0.030372 | 0.280245 |
| 3656 | 0.005039 | 0.109044 | 0.437077 |
| 3657 | 0.009618 | −0.13852 | −0.34652 |
| 3658 | 0.010488 | −0.100563 | −0.316822 |
| 3659 | 0.022109 | 0.00349 | 0.254205 |
| 3660 | −0.02924 | 0.248024 | 0.349343 |
| 3661 | −0.01618 | −0.25316 | −0.5936 |
| 3662 | −0.00179 | −0.29298 | −0.4016 |
| 3663 | 0.010692 | 0.195257 | 0.259274 |
| 3664 | −0.02055 | −0.16417 | −0.63881 |
| 3665 | 0.006512 | −0.20855 | −0.22497 |
| 3666 | 0.014762 | 0.130635 | 0.27316 |
| 3667 | 0.005038 | −0.15002 | −0.3011 |
| 3668 | −0.0037 | 0.161125 | 0.440317 |
| 3669 | −0.01488 | 0.17173 | 0.377036 |
| 3670 | 0.004662 | 0.204447 | 0.405003 |
| 3671 | 0.031363 | 0.225054 | 0.391684 |
| 3672 | −0.01716 | 0.363938 | 0.454998 |
| 3673 | −0.02599 | −0.26151 | −0.85852 |
| 3674 | 0.007781 | 0.240323 | 0.617296 |
| 3675 | 0.017188 | 0.381003 | 0.584545 |
| 3676 | −0.01941 | −0.18262 | −0.52435 |
| 3678 | −0.07755 | −0.25462 | −1.21457 |
| 3679 | 0.029503 | 0.26528 | 0.545758 |
| 3680 | −0.01146 | −0.05606 | −0.57839 |
| 3681 | 0.02916 | 0.284717 | 0.399181 |
| 3682 | 0.031311 | 0.886442 | 1.043437 |
| 3684 | −0.05039 | −0.22784 | −0.67536 |
| 3687 | 0.025134 | 0.077778 | 0.233685 |
| 3688 | −0.03452 | −0.2365 | −0.6591 |
| 3689 | 0.020959 | 0.135435 | 0.442065 |
| 3690 | −0.00061 | −0.22418 | −0.21696 |
| 3691 | 0.030615 | 0.368867 | 0.463789 |
| 3693 | 0.008242 | 0.13538 | 0.238988 |
| 3694 | 0.022164 | 0.24485 | 0.369787 |
| 3695 | 0.008348 | 0.345415 | 0.445491 |
| 3697 | 0.027044 | 0.275282 | 0.423066 |
| 3698 | 0.008222 | 0.350065 | 0.740909 |
| 3699 | −0.00952 | −0.19156 | −0.22617 |
| 3700 | −0.00774 | −0.16099 | −0.19923 |
| 3701 | −0.05313 | −0.33669 | −0.5235 |
| 3702 | 0.003856 | 0.209935 | 0.358961 |
| 3703 | 0.007194 | −0.37491 | −0.31409 |
| 3704 | 0.001122 | 0.2761 | 0.371209 |
| 3705 | −0.00709 | 0.357332 | 0.489837 |
| 3706 | 0.040931 | 0.462946 | 0.60049 |
| 3707 | −0.00516 | 0.271088 | 0.294429 |
| 3708 | 0.00797 | 0.305948 | 0.372261 |
| 3709 | −0.01333 | −0.34526 | −0.32565 |
| 3710 | −0.00842 | 0.743893 | 0.603555 |
| 3712 | 0.005041 | −0.17492 | −0.29702 |
| 3713 | −0.0289 | −0.19531 | −0.40228 |
| 3714 | 0.011165 | 0.155011 | 0.279136 |
| 3715 | −0.00133 | 0.390666 | 0.773649 |
| 3716 | 0.021292 | 0.217723 | 0.532074 |
| 3717 | 0.029764 | 0.133139 | 0.363509 |
| 3719 | −0.00569 | 0.272222 | 0.395599 |
| 3720 | 0.006975 | 0.316981 | −0.554667 |
| 3721 | −0.00718 | 0.174198 | 0.213069 |
| 3722 | −0.01824 | −0.14028 | −0.55819 |
| 3723 | 0.001449 | 0.433877 | 0.750806 |
| 3724 | −0.06438 | −0.34026 | −0.90631 |
| 3726 | 0.016783 | 0.074532 | 0.32937 |
| 3727 | −0.023638 | −0.142935 | −0.651747 |
| 3728 | 0.005353 | 0.185561 | 0.374248 |
| 3729 | 0.015333 | 0.466716 | 0.338765 |
| 3730 | −0.11273 | −0.34033 | −0.74304 |
| 3731 | −0.052 | −0.44987 | −1.00602 |
| 3732 | 0.001521 | 0.087123 | 0.219262 |
| 3733 | −0.00774 | 0.297037 | 0.411744 |
| 3734 | 0.007834 | −0.27308 | −0.2795 |
| 3735 | −0.0003 | 0.1427 | 0.284445 |
| 3736 | −0.00304 | 0.247981 | 0.419058 |
| 3737 | −0.05269 | −0.14303 | −0.9691 |
| 3738 | 0.058799 | 0.23747 | 0.50269 |
| 3739 | −0.02901 | −0.34538 | −0.60565 |
| 3740 | 0.008498 | 0.100432 | 0.280781 |
| 3741 | −0.0008 | 0.258263 | 0.455968 |
| 3742 | −0.04584 | 0.066503 | 0.375283 |
| 3743 | −0.03349 | 0.288905 | 0.502598 |
| 3744 | −0.04514 | −0.31129 | −1.31612 |
| 3745 | 0.008607 | 0.236502 | 0.379077 |
| 3747 | 0.025051 | 0.654614 | 0.673397 |
| 3748 | −0.00402 | −0.23433 | −0.60235 |
| 3749 | −0.03559 | 1.065448 | 1.023898 |
| 3750 | −0.02419 | 0.213775 | 0.639856 |
| 3751 | −0.03336 | −0.27007 | −0.76418 |
| 3752 | −0.0443 | 0.339835 | 0.498822 |
| 3753 | −0.01658 | 0.10543 | 0.226121 |
| 3754 | 0.009493 | 0.275559 | 0.623179 |
| 3755 | −0.021919 | 0.195442 | 0.379175 |
| 3756 | 0.007138 | 0.218329 | 0.357365 |
| 3757 | −0.00525 | −0.21511 | −0.32728 |

TABLE 1a-continued phase reporter genes

| SEQ ID NO | log(ratio) CP | log(ratio) AP | log(ratio) BC |
|---|---|---|---|
| 3758 | 0.012473 | 0.201175 | 0.362596 |
| 3759 | −0.01279 | −0.2507 | −0.53842 |
| 3760 | 0.025025 | 0.151079 | 0.286126 |
| 3761 | 0.013849 | 0.149988 | 0.305557 |
| 3762 | −0.02366 | −0.28636 | −0.81937 |
| 3764 | −0.01564 | −0.19303 | −0.26092 |
| 3766 | −0.0078 | 0.33788 | 0.559023 |
| 3767 | −0.14766 | −0.58681 | −0.8303 |
| 3768 | −0.02365 | −0.02657 | −0.40423 |
| 3769 | −0.07505 | −0.45329 | −0.81364 |
| 3770 | 0.014256 | 0.252952 | 0.791686 |
| 3771 | 0.000762 | 0.414331 | 0.473554 |
| 3772 | −0.04075 | −0.10969 | −0.87339 |
| 3773 | 0.009132 | −0.19384 | −0.26354 |
| 3774 | 0.006782 | 0.308886 | 0.586722 |
| 3775 | 0.016697 | −0.13758 | −0.22465 |
| 3776 | −0.00641 | −0.09848 | −0.32179 |
| 3777 | −0.01008 | −0.30175 | −0.74848 |
| 3778 | −0.18892 | −0.16936 | −0.96093 |
| 3779 | 0.015198 | 0.460693 | 0.920111 |
| 3780 | −0.00343 | 0.30979 | 0.443498 |
| 3781 | 0.007713 | −0.22269 | −0.19107 |
| 3782 | −0.00516 | −0.21752 | −0.43031 |
| 3783 | 0.008031 | −0.275 | −0.26959 |
| 3784 | 0.001544 | 0.152755 | 0.22911 |
| 3786 | 0.033983 | 0.314454 | 0.467167 |
| 3787 | −0.00797 | −0.17558 | −0.34756 |
| 3788 | −0.01013 | 0.252803 | 0.451763 |
| 3789 | 0.011368 | −0.17659 | −0.27607 |
| 3790 | −0.01187 | 0.559225 | 0.865392 |
| 3791 | 0.007796 | −0.11536 | −0.75804 |
| 3794 | −0.02133 | −0.24973 | −0.60104 |
| 3795 | 0.006022 | −0.33209 | −0.26862 |
| 3796 | 0.010623 | 0.370266 | 0.38694 |
| 3797 | 0.014382 | −0.13074 | −0.1862 |
| 3798 | −0.00565 | −0.31968 | −0.72164 |
| 3799 | −0.00825 | −0.25969 | −0.45754 |
| 3801 | −0.00696 | −0.08637 | −0.25043 |
| 3802 | 0.017105 | 0.245965 | 0.524084 |
| 3803 | 0.012106 | −0.10429 | −0.39847 |
| 3805 | 0.000356 | 0.413256 | 0.478106 |
| 3806 | 0.010934 | 0.29635 | 0.386202 |
| 3807 | 0.000112 | −0.09254 | −0.20172 |
| 3808 | −0.029 | −0.27661 | −0.49614 |
| 3809 | 0.010957 | 0.143925 | 0.427276 |
| 3810 | 0.013606 | 0.288317 | 0.384979 |
| 3811 | 0.00107 | −0.14349 | −0.23862 |
| 3813 | 0.015757 | 0.049963 | 0.322916 |
| 3814 | 0.012775 | 0.268704 | 0.489882 |
| 3815 | −0.00178 | −0.24858 | −0.55539 |
| 3816 | 0.020478 | 0.328518 | 0.363496 |
| 3817 | 0.024418 | 0.191881 | 0.339502 |
| 3818 | −0.01942 | −0.29161 | −0.28157 |
| 3819 | 0.000103 | 0.270294 | 0.325421 |
| 3820 | −0.01143 | 0.488676 | 1.0676 |
| 3821 | −0.00952 | 0.403054 | 0.422651 |
| 3822 | 0.009236 | −0.18298 | −0.28602 |
| 3823 | −0.00386 | −0.02828 | −0.23222 |
| 3824 | 0.014109 | 0.222256 | 0.352421 |
| 3825 | 0.02032 | 0.265215 | 0.459123 |
| 3826 | 0.033585 | 0.252623 | 0.438713 |
| 3827 | −0.03236 | −0.26125 | −0.51846 |
| 3828 | 0.034594 | 0.156209 | 0.285878 |
| 3829 | 0.020227 | 0.248677 | 0.346795 |
| 3830 | 0.014978 | 0.091181 | 0.209185 |
| 3831 | −0.00336 | −0.26565 | −0.32013 |
| 3832 | −0.01958 | −0.3121 | −0.42927 |
| 3833 | 0.026113 | 0.382008 | 0.532301 |
| 3834 | 0.023708 | −0.1401 | −0.30331 |
| 3835 | 0.005344 | 0.232229 | 0.33731 |
| 3837 | 0.015978 | 0.148698 | 0.33504 |
| 3838 | −0.06039 | −0.39414 | −1.08079 |
| 3839 | −0.05249 | −0.43012 | −0.97039 |
| 3840 | 0.035352 | 0.420428 | 0.634365 |
| 3841 | 0.014726 | 0.065969 | 0.296027 |
| 3842 | 0.014931 | 0.337795 | 0.48071 |
| 3843 | 0.000632 | 0.084208 | 0.363903 |
| 3846 | −0.12428 | −0.61888 | −1.14868 |
| 3847 | 0.024094 | 0.242898 | 0.532951 |
| 3848 | 0.014222 | −0.20545 | −0.18744 |
| 3850 | −0.0071 | −0.39614 | −1.31291 |
| 3851 | 0.012684 | 0.070752 | 0.274745 |
| 3852 | 0.02372 | 0.172396 | 0.342361 |
| 3853 | 0.00189 | −0.145487 | −0.229147 |
| 3854 | −0.00101 | −0.21912 | −0.72961 |
| 3855 | 0.007222 | −0.15336 | −0.26965 |
| 3856 | 0.007543 | −0.15408 | −0.15187 |
| 3858 | 0.018762 | −0.28212 | −0.40115 |
| 3859 | −0.08983 | −0.08099 | −0.96191 |
| 3860 | 0.004134 | 0.11989 | 0.775235 |
| 3861 | −0.00476 | 0.799769 | 0.775464 |
| 3862 | −0.02069 | 0.619347 | 0.552404 |
| 3863 | 0.023825 | 0.198966 | 0.288914 |
| 3864 | 0.002065 | −0.18112 | −0.3627 |
| 3865 | 0.023799 | 0.373823 | 0.502792 |
| 3866 | −0.07514 | −0.16355 | −1.15587 |
| 3867 | −0.02357 | 0.426881 | 0.768005 |
| 3868 | −0.06742 | −0.22372 | −1.48362 |
| 3869 | 0.007952 | −0.20656 | −0.18147 |
| 3870 | −0.00995 | −0.18825 | −0.32561 |
| 3871 | −0.09391 | −0.49811 | −0.67155 |
| 3872 | −0.01577 | −0.30748 | −0.36469 |
| 3873 | 0.00135 | −0.177 | −0.26574 |
| 3874 | 0.01437 | −0.27493 | −0.64992 |
| 3875 | 0.008601 | 0.175417 | 0.368725 |
| 3877 | 0.0215 | 0.239552 | 0.543968 |
| 3878 | 0.007867 | −0.14612 | −0.219 |
| 3879 | −0.02127 | −0.13431 | −0.5214 |
| 3881 | −0.01449 | −0.22729 | −0.38659 |
| 3882 | −0.008 | −0.28045 | −0.35033 |
| 3883 | −0.00282 | −0.22456 | −0.3246 |
| 3884 | −0.01006 | 0.125335 | 0.437432 |
| 3885 | −0.0341 | −0.33793 | −0.64981 |
| 3886 | −0.02831 | −0.22518 | −0.44843 |
| 3887 | −0.00342 | −0.15249 | −0.46289 |
| 3888 | 0.014393 | 0.484554 | 0.495931 |
| 3889 | 0.001776 | 0.262078 | 0.383028 |
| 3890 | 0.011023 | −0.01062 | −0.44164 |
| 3892 | 0.004332 | −0.00059 | −0.38242 |
| 3893 | 0.001464 | −0.14286 | −0.18126 |
| 3894 | −0.01231 | −0.2316 | −0.32005 |
| 3895 | 0.018186 | 0.089257 | 0.210466 |
| 3896 | 0.0075 | −0.17357 | −0.27499 |
| 3897 | −0.00568 | −0.14148 | −0.37829 |
| 3898 | 0.002511 | −0.14907 | −0.15297 |
| 3899 | −0.0092 | −0.1654 | −0.41466 |
| 3900 | 0.01744 | 0.108167 | 0.303529 |
| 3902 | −0.21525 | −0.62727 | −0.88264 |
| 3903 | 0.012294 | 0.101754 | 0.422339 |
| 3904 | 0.007328 | −0.12993 | −0.17647 |
| 3906 | 0.032547 | 0.2237 | 0.374842 |
| 3907 | 0.020824 | 0.455249 | 0.666732 |
| 3908 | 0.001958 | −0.08941 | −0.20901 |
| 3909 | −0.03403 | −0.28041 | −0.66761 |
| 3910 | 0.005124 | 0.373303 | 0.456396 |
| 3911 | 0.007527 | 0.436713 | 0.635286 |
| 3912 | −0.01004 | −0.18805 | −0.1945 |
| 3913 | −0.13841 | 0.130768 | −0.78612 |
| 3914 | 0.005593 | −0.24982 | −0.45921 |
| 3916 | 0.007871 | 0.294561 | 0.472056 |
| 3917 | 0.000456 | 0.350453 | 0.512085 |
| 3918 | −0.00721 | −0.20685 | −0.30782 |
| 3919 | 0.00249 | 0.4553 | 0.467418 |
| 3920 | 0.003433 | 0.234106 | 0.347743 |
| 3921 | 0.02159 | 0.267666 | 0.272491 |
| 3922 | −0.01034 | −0.23596 | −0.40316 |
| 3923 | −0.0218 | −0.17331 | −0.31503 |
| 3924 | −0.01052 | −0.2608 | −0.45258 |
| 3926 | 0.005481 | −0.19415 | −0.38862 |
| 3927 | −0.00198 | −0.15223 | −0.26378 |

TABLE 1a-continued phase reporter genes

| SEQ ID NO | log(ratio) CP | log(ratio) AP | log(ratio) BC |
|---|---|---|---|
| 3928 | −0.00481 | −0.19212 | −0.60011 |
| 3929 | −0.02907 | −0.31237 | −0.67115 |
| 3930 | 0.018932 | 0.502499 | 0.630779 |
| 3931 | 0.007823 | 0.330178 | 0.374828 |
| 3932 | −0.00625 | −0.19177 | −0.36188 |
| 3934 | −0.01138 | −0.16719 | −0.62327 |
| 3936 | 0.013418 | −0.12059 | −0.21994 |
| 3937 | −0.00602 | −0.17249 | −0.19886 |
| 3938 | −0.00093 | −0.18338 | −0.21621 |
| 3940 | −0.0063 | 0.32237 | 0.447277 |
| 3941 | −0.03123 | 0.753525 | 1.028617 |
| 3942 | −0.03893 | −0.15886 | −1.03693 |
| 3943 | 0.016177 | 0.318878 | 0.500708 |
| 3944 | 0.029472 | −0.14649 | −0.37317 |
| 3945 | −0.15185 | −0.49868 | −0.607 |
| 3946 | −0.09644 | −0.46037 | −0.57596 |
| 3948 | 0.010157 | 0.279247 | 0.48872 |
| 3949 | 0.002141 | −0.34666 | −0.2661 |
| 3950 | −0.03206 | −0.28804 | −0.36911 |
| 3951 | 0.006273 | 0.122116 | 0.414685 |
| 3952 | −0.04024 | 0.176953 | 0.383377 |
| 3953 | 0.0072 | −0.23691 | −0.34253 |
| 3954 | 0.012744 | −0.16741 | −0.24655 |
| 3955 | −0.019735 | −0.159647 | −0.33003 |
| 3957 | −0.00172 | 0.066009 | 0.290683 |
| 3958 | 0.000007 | 0.258618 | 0.366426 |
| 3959 | −0.07307 | −0.35372 | −0.42584 |
| 3960 | −0.005 | −0.29445 | −0.89736 |
| 3962 | −0.00971 | −0.14007 | −0.77128 |
| 3963 | −0.0012 | −0.19036 | −0.18134 |
| 3964 | −0.00871 | −0.31654 | −0.73351 |
| 3965 | 0.007545 | −0.19764 | −0.31117 |
| 3967 | −0.09077 | −0.42429 | −0.50192 |
| 3968 | 0.002684 | −0.24249 | −0.27393 |

TABLE 1b phase reporter genes

| SEQ ID NO | log(ratio) CP | log(ratio) AP | log(ratio) BC |
|---|---|---|---|
| 56 | −0.01844 | −0.2843 | −0.52572 |
| 65 | −0.043 | −0.27935 | −0.61442 |
| 70 | −0.02677 | 0.321263 | 0.479287 |
| 177 | −0.02343 | −0.25951 | −0.53988 |
| 190 | −0.04631 | −0.22027 | −0.61104 |
| 199 | −0.19435 | −0.66091 | −1.74771 |
| 1758 | −0.0427 | −0.06237 | −0.68566 |
| 1773 | 0.032164 | 0.295407 | 0.487261 |
| 1774 | 0.02296 | 0.304684 | 0.561645 |
| 1786 | 0.014041 | 0.225619 | 0.584752 |
| 1815 | 0.035253 | 0.254518 | 0.53063 |
| 1823 | 0.014591 | 0.300107 | 0.456781 |
| 3925 | −0.04398 | −0.3128 | −0.99975 |
| 3933 | −0.0347 | −0.12523 | −0.74375 |
| 3947 | −0.04231 | −0.53589 | −1.45253 |
| 3956 | −0.00856 | −0.16684 | −0.95119 |

Tables 2a and 2b list a set of 386 progression genes identified by searching for phase reporter genes after removing CD34 content ($p<10^{-8}$) (the "progression geneset"). The CD34 content is removed by subtracting the expression level of each gene in a sample of CD34+ cells from the expression level of the gene in a tumor sample from a CML patient. The progression genes are identified by their SEQ ID NOs in Tables 2a and 2b. Information for these genes is presented in Table 8. Table 2a lists progression genes that were not disclosed in U.S. Patent Application Publication 2003/01044026 A1, dated Jun. 5, 2003. Table 2b lists progression genes that were also identified in U.S. Patent Application Publication 2003/01044026 A1, dated Jun. 5, 2003. Tables 2a and 2b also listed for each gene the log ratio of CD34+(−) expression level of the gene (i.e., the expression level of the gene in a tumor sample from a CML patient minus the expression level of the gene in a sample of CD34+ cells) in samples from patients of a particular phase (e.g., CP, AP, or BC) versus CD34+(−) expression level of the gene in a pool of CML bone marrow samples from chronic phase patients. Each log ratio column thus contains expression levels of markers for a particular phase.

TABLE 2a progression genes

| SEQ ID NO | log(ratio) CP | log(ratio) AP | log(ratio) BC |
|---|---|---|---|
| 2 | −0.013036 | 0.331191 | 0.13619 |
| 22 | −0.027625 | 0.25124 | 0.297168 |
| 44 | −0.008283 | −0.175784 | −0.35176 |
| 74 | −0.018621 | 0.110352 | −0.541362 |
| 75 | 0.012898 | −0.15485 | −0.081578 |
| 98 | −0.0065 | 0.226199 | 0.384576 |
| 118 | 0.0235 | 0.413795 | 0.572899 |
| 120 | −0.068801 | −0.238346 | −0.788486 |
| 123 | −0.014776 | 0.153884 | 0.315337 |
| 127 | 0.014361 | 0.2732 | 0.196317 |
| 146 | −0.062898 | −0.026859 | −0.467529 |
| 166 | −0.008117 | −0.02223 | −0.588809 |
| 192 | −0.03375 | −0.376045 | −0.824014 |
| 201 | −0.046038 | 0.745451 | 0.938831 |
| 252 | −0.011159 | −0.181168 | −0.338022 |
| 260 | −0.014983 | 0.169381 | 0.378207 |
| 261 | 0.002136 | −0.013939 | 0.252784 |
| 277 | −0.059071 | 0.153895 | −0.707755 |
| 282 | −0.011292 | 0.246831 | 0.217263 |
| 300 | −0.015553 | 0.264616 | 0.213715 |
| 312 | −0.006268 | −0.169392 | −0.415121 |
| 321 | 0.017293 | 0.264073 | 0.351815 |
| 329 | 0.015519 | −0.110525 | −0.132442 |
| 348 | 0.003377 | 0.292866 | 0.385025 |
| 359 | 0.011735 | −0.238758 | −0.159133 |
| 361 | 0.0199 | −0.29195 | −0.308127 |
| 369 | 0.015105 | −0.30705 | −0.467622 |
| 379 | 0.011972 | 0.153175 | 0.287232 |
| 382 | −0.034613 | 0.539856 | 0.385649 |
| 392 | −0.018091 | 0.211741 | 0.151359 |
| 397 | 0.001911 | −0.204817 | −0.142157 |
| 398 | −0.055256 | 0.454774 | 0.463563 |
| 401 | 0.010902 | −0.0223 | −0.435077 |
| 407 | 0.022957 | −0.146156 | −0.144178 |
| 408 | 0.000587 | 0.042633 | 0.171636 |
| 413 | −0.004104 | −0.021944 | −0.541188 |
| 432 | −0.021105 | 0.318234 | 0.36938 |
| 453 | 0.000187 | −0.016503 | −0.233794 |
| 462 | 0.015733 | −0.049378 | −0.203749 |
| 464 | −0.007901 | −0.242419 | −0.192786 |
| 468 | −0.069818 | 0.055712 | −0.792861 |
| 483 | 0.022087 | 0.013675 | −0.264371 |
| 487 | −0.044506 | −0.226859 | −0.730255 |
| 490 | 0.032225 | 0.697253 | 0.473438 |
| 493 | 0.005365 | 0.117615 | 0.279824 |
| 506 | 0.002222 | 0.244418 | 0.413136 |
| 508 | −0.001048 | 0.149848 | 0.252886 |
| 513 | −0.025942 | 0.105185 | −0.589267 |
| 532 | 0.013898 | −0.091144 | −0.105794 |
| 535 | −0.02973 | 0.31094 | −0.640132 |
| 549 | −0.024057 | −0.192808 | −0.507538 |
| 562 | −0.007465 | −0.085295 | −0.451408 |
| 564 | 0.010706 | 0.16159 | 0.377863 |
| 565 | −0.013377 | 0.189935 | 0.358398 |
| 596 | −0.027369 | −0.300983 | −0.676728 |
| 602 | −0.02947 | 0.152602 | 0.288592 |
| 607 | −0.03208 | 0.163679 | 0.433561 |
| 629 | −0.017135 | 0.164754 | 0.393246 |
| 631 | −0.005919 | 0.029702 | 0.182895 |
| 638 | 0.005995 | 0.158171 | 0.295784 |
| 641 | −0.002351 | 0.141381 | −0.371398 |
| 644 | 0.011035 | −0.188829 | −0.236191 |

TABLE 2a-continued progression genes

| SEQ ID NO | log(ratio) CP | log(ratio) AP | log(ratio) BC |
|---|---|---|---|
| 648 | −0.000305 | 0.09399 | 0.156447 |
| 671 | −0.052686 | 0.224817 | −0.778464 |
| 678 | −0.011662 | −0.03032 | −0.483853 |
| 686 | −0.044146 | 0.393448 | 0.352519 |
| 687 | 0.004128 | 0.014188 | 0.147004 |
| 688 | −0.007112 | 0.135577 | −0.384238 |
| 692 | 0.01078 | −0.193913 | −0.339249 |
| 694 | 0.026903 | 0.238728 | 0.198984 |
| 699 | 0.002836 | −0.136336 | −0.204499 |
| 700 | −0.003573 | 0.186663 | 0.111998 |
| 702 | −0.004795 | 0.43693 | 0.231795 |
| 704 | 0.008652 | 0.448527 | 0.623811 |
| 708 | 0.035423 | −0.072534 | −0.243577 |
| 710 | 0.00051 | −0.260385 | −0.325256 |
| 715 | −0.031368 | −0.034762 | −0.28179 |
| 725 | 0.018721 | −0.110491 | −0.07631 |
| 727 | 0.011701 | 0.352484 | 0.599663 |
| 730 | 0.007214 | −0.100867 | −0.390067 |
| 739 | −0.021549 | 0.313399 | 0.230556 |
| 758 | 0.006066 | 0.197232 | 0.154028 |
| 774 | −0.011428 | 0.297906 | 0.460758 |
| 781 | 0.049464 | 0.661373 | 0.621414 |
| 789 | −0.011135 | 0.073025 | 0.220549 |
| 794 | 0.00587 | −0.124811 | −0.092198 |
| 852 | −0.009777 | 0.061913 | 0.217413 |
| 862 | 0.012512 | 0.101103 | 0.346959 |
| 878 | −0.007159 | 0.624676 | 0.342539 |
| 879 | 0.015292 | 0.310113 | −0.619546 |
| 902 | 0.01057 | 0.108517 | 0.282889 |
| 906 | 0.009153 | 0.106628 | 0.432846 |
| 912 | −0.03355 | −0.086456 | −0.556116 |
| 913 | −0.002153 | −0.162393 | −0.176945 |
| 934 | −0.001515 | 0.49437 | 0.349162 |
| 949 | −0.009006 | −0.003959 | −0.260665 |
| 969 | 0.009521 | −0.194416 | −0.088755 |
| 983 | −0.009189 | −0.179037 | −0.279808 |
| 984 | 0.003783 | 0.428077 | −0.304577 |
| 995 | 0.018194 | 0.115536 | 0.453015 |
| 1005 | −0.004206 | 0.264613 | 0.406912 |
| 1006 | 0.013715 | 0.253173 | −0.48171 |
| 1014 | −0.027032 | 0.218431 | 0.369874 |
| 1027 | −0.097802 | 0.14838 | −0.409138 |
| 1030 | 0.012193 | −0.156904 | −0.129918 |
| 1036 | 0.018457 | 0.150121 | 0.282032 |
| 1042 | 0.016406 | 0.12399 | 0.254155 |
| 1047 | −0.010956 | 0.160388 | 0.293704 |
| 1053 | −0.003597 | 0.168234 | 0.188554 |
| 1065 | 0.041337 | 0.356808 | 0.457428 |
| 1086 | 0.012167 | 0.126556 | 0.308808 |
| 1089 | −0.056921 | 0.265345 | 0.488138 |
| 1092 | 0.031164 | 0.741399 | 0.650443 |
| 1093 | −0.019458 | 0.265262 | 0.281598 |
| 1100 | −0.026376 | −0.107488 | 0.120579 |
| 1105 | 0.000402 | 0.241675 | 0.374547 |
| 1106 | 0.013275 | 0.053145 | 0.284804 |
| 1111 | 0.006695 | 0.390109 | 0.467033 |
| 1113 | 0.00931 | −0.151037 | −0.094238 |
| 1145 | −0.003373 | −0.121256 | −0.288823 |
| 1161 | −0.036419 | −0.112814 | −0.289979 |
| 1169 | 0.004364 | −0.149179 | −0.137703 |
| 1180 | −0.003015 | 0.149485 | 0.243152 |
| 1181 | −0.006552 | 0.354743 | 0.273738 |
| 1182 | −0.063925 | 0.133911 | −0.796733 |
| 1201 | −0.024631 | 0.061529 | −0.462534 |
| 1211 | −0.0131 | 0.42541 | 0.389219 |
| 1227 | 0.003709 | −0.172158 | −0.119982 |
| 1228 | −0.001968 | −0.182794 | −0.15988 |
| 1234 | 0.003295 | −0.168464 | −0.233929 |
| 1264 | 0.007382 | −0.120962 | −0.228059 |
| 1288 | −0.025178 | 0.393585 | 0.566352 |
| 1294 | 0.004545 | 0.126708 | 0.283647 |
| 1308 | −0.051939 | −0.225136 | −1.142094 |
| 1324 | 0.000802 | 0.195216 | 0.368476 |
| 1327 | 0.0232 | 0.29162 | 0.330751 |
| 1328 | 0.016117 | −0.125314 | −0.193334 |
| 1333 | −0.001615 | 0.157104 | 0.160918 |
| 1334 | −0.003194 | 0.078374 | −0.585411 |
| 1352 | −0.013243 | −0.259131 | −0.724495 |
| 1364 | 0.020286 | −0.059623 | −0.36669 |
| 1394 | −0.038031 | 0.569499 | 0.281012 |
| 1400 | −0.034692 | −0.392913 | −0.855372 |
| 1408 | 0.012613 | 0.202286 | −0.410509 |
| 1421 | 0.015803 | 0.301704 | −0.280571 |
| 1434 | 0.023441 | 0.24849 | 0.404885 |
| 1465 | 0.011301 | 1.119758 | 0.380817 |
| 1475 | 0.002495 | −0.174538 | −0.144746 |
| 1489 | −0.005825 | 0.171399 | 0.198891 |
| 1503 | −0.010846 | 0.33961 | 0.344346 |
| 1538 | 0.008774 | 0.250497 | 0.380736 |
| 1544 | −0.001566 | −0.118486 | −0.225612 |
| 1565 | 0.003841 | −0.24087 | −0.188087 |
| 1586 | −0.05968 | 0.131214 | 0.231979 |
| 1596 | −0.012267 | 0.315077 | 0.462982 |
| 1598 | −0.040336 | 0.405119 | 0.295977 |
| 1600 | 0.016473 | 0.171937 | 0.480309 |
| 1613 | 0.018672 | 0.639835 | 0.686131 |
| 1615 | 0.003796 | −0.155045 | −0.123787 |
| 1621 | 0.000743 | 0.182262 | 0.22026 |
| 1622 | −0.01422 | 0.108504 | 0.441113 |
| 1624 | −0.003494 | −0.128858 | −0.416283 |
| 1631 | −0.066238 | 0.08156 | 0.35517 |
| 1644 | 0.012751 | 0.004567 | −0.256495 |
| 1653 | −0.051037 | 0.575903 | 0.659891 |
| 1666 | −0.005018 | 0.304418 | 0.391773 |
| 1667 | 0.020618 | −0.152906 | −0.073514 |
| 1674 | 0.001052 | 0.230389 | 0.365551 |
| 1707 | −0.10203 | −0.508005 | −0.433948 |
| 1713 | −0.000033 | 0.227119 | 0.293211 |
| 1723 | −0.008555 | −0.013157 | 0.311742 |
| 1726 | 0.01878 | −0.134004 | −0.114544 |
| 1729 | 0.017853 | 0.122885 | 0.403719 |
| 1740 | 0.000129 | 0.082648 | 0.202706 |
| 1744 | −0.008165 | 0.028902 | 0.157605 |
| 1754 | −0.03329 | 0.24969 | 0.276391 |
| 1756 | −0.006572 | −0.090777 | −0.187299 |
| 1764 | −0.023292 | 0.061919 | 0.439367 |
| 1765 | −0.069608 | 0.229406 | −0.942888 |
| 1769 | 0.004735 | 0.111816 | 0.380203 |
| 1772 | −0.053231 | 0.914364 | 0.703125 |
| 1784 | 0.011665 | 0.266176 | 0.262102 |
| 1798 | 0.006863 | 0.125618 | 0.179833 |
| 1802 | −0.006187 | −0.271892 | −0.547214 |
| 1813 | 0.004929 | 0.074195 | −0.38902 |
| 1822 | 0.008709 | 0.058535 | 0.172787 |
| 1851 | −0.038706 | 0.176417 | −0.585557 |
| 1854 | 0.011347 | −0.148867 | −0.08759 |
| 1856 | 0.023502 | −0.039695 | −0.260378 |
| 1857 | 0.001175 | −0.00306 | −0.260983 |
| 1864 | −0.023131 | −0.110894 | −0.595764 |
| 1902 | 0.011275 | −0.14224 | −0.083923 |
| 1906 | −0.018987 | −0.066969 | −0.26783 |
| 1910 | −0.014553 | −0.104128 | −0.202699 |
| 1927 | 0.016189 | 0.022638 | −0.210103 |
| 1936 | −0.008747 | −0.190402 | −0.17087 |
| 1966 | 0.009815 | −0.207021 | −0.109949 |
| 1973 | 0.025222 | 0.269645 | −0.254999 |
| 1997 | 0.000408 | −0.206852 | −0.093692 |
| 1998 | −0.027543 | −0.140155 | −0.699914 |
| 2024 | 0.002746 | 0.021635 | 0.240366 |
| 2041 | −0.006546 | 0.162101 | 0.390622 |
| 2042 | 0.003359 | −0.068862 | −0.130822 |
| 2054 | 0.003287 | 0.188219 | 0.311283 |
| 2056 | 0.017212 | −0.089889 | −0.160576 |
| 2059 | −0.020181 | 1.117376 | 0.593213 |
| 2067 | −0.034481 | −0.314757 | −0.571005 |
| 2069 | 0.020052 | −0.126164 | −0.092528 |
| 2084 | −0.030024 | 0.35537 | 0.651561 |
| 2116 | 0.013573 | −0.038963 | −0.25063 |
| 2121 | −0.071015 | 0.041386 | −0.850915 |
| 2127 | −0.042666 | 0.689794 | 0.248637 |
| 2132 | −0.001535 | 0.140887 | 0.196882 |
| 2136 | −0.016679 | 0.5014 | 0.158751 |

TABLE 2a-continued progression genes

| SEQ ID NO | log(ratio) CP | log(ratio) AP | log(ratio) BC |
|---|---|---|---|
| 2148 | 0.007504 | −0.089503 | −0.424451 |
| 2162 | −0.018781 | −0.151041 | −0.25681 |
| 2196 | 0.001252 | −0.045446 | −0.145241 |
| 2197 | 0.011939 | 0.082814 | 0.421803 |
| 2211 | 0.016656 | −0.118424 | −0.17814 |
| 2218 | −0.001994 | 0.132273 | 0.102983 |
| 2222 | −0.080043 | 0.129091 | 0.187538 |
| 2247 | 0.014934 | −0.139989 | −0.120912 |
| 2248 | −0.012664 | 0.324801 | 0.485921 |
| 2259 | 0.009135 | 0.109045 | −0.390417 |
| 2276 | 0.010096 | −0.162022 | −0.120129 |
| 2277 | 0.013334 | 0.571954 | −0.227756 |
| 2282 | 0.003573 | −0.28411 | −0.296893 |
| 2286 | −0.00426 | −0.361198 | −0.342302 |
| 2298 | −0.042053 | −0.27671 | −0.589169 |
| 2302 | 0.008627 | −0.135924 | −0.184813 |
| 2310 | −0.001488 | −0.154965 | −0.151611 |
| 2334 | 0.022782 | 0.118742 | 0.155021 |
| 2344 | −0.046131 | −0.043556 | 0.354686 |
| 2373 | 0.013698 | 0.020747 | −0.300319 |
| 2388 | −0.057599 | 0.240909 | 0.4755 |
| 2392 | 0.007643 | −0.159192 | −0.126831 |
| 2398 | −0.04217 | 0.124478 | −0.490219 |
| 2414 | 0.006247 | 0.039279 | 0.231344 |
| 2458 | −0.047592 | −0.021181 | 0.62265 |
| 2464 | 0.009492 | 0.497028 | 0.550105 |
| 2465 | −0.061732 | 0.844778 | 0.746645 |
| 2474 | −0.010535 | 0.317139 | 0.32638 |
| 2479 | 0.009625 | −0.032207 | −0.206553 |
| 2482 | 0.007713 | 0.134365 | 0.22816 |
| 2486 | 0.008277 | −0.165135 | −0.505359 |
| 2494 | −0.008876 | −0.013903 | −0.345788 |
| 2495 | 0.023159 | −0.11675 | −0.103801 |
| 2501 | 0.024313 | −0.133841 | −0.10317 |
| 2517 | 0.010041 | −0.026346 | −0.284518 |
| 2541 | 0.001637 | −0.123709 | −0.165061 |
| 2555 | 0.009862 | −0.295888 | −0.195271 |
| 2561 | 0.003441 | 0.143297 | 0.393623 |
| 2563 | −0.001684 | −0.157035 | −0.180935 |
| 2567 | 0.018774 | 0.481516 | 0.617251 |
| 2580 | 0.001717 | 0.072093 | 0.449871 |
| 2584 | −0.108511 | 0.237285 | 0.358945 |
| 2591 | −0.014377 | 0.016583 | 0.170925 |
| 2599 | −0.004314 | 0.138559 | −0.449886 |
| 2603 | 0.011638 | −0.148946 | −0.141157 |
| 2606 | −0.008722 | −0.002843 | −0.263652 |
| 2612 | 0.006823 | −0.083968 | −0.181774 |
| 2627 | 0.033377 | −0.002066 | −0.307558 |
| 2631 | −0.091338 | −0.170022 | −1.015137 |
| 2637 | 0.000709 | −0.02223 | −0.36686 |
| 2654 | −0.018035 | −0.080645 | −0.380195 |
| 2659 | 0.022976 | 0.537017 | 0.816212 |
| 2664 | −0.002476 | −0.035144 | −0.354387 |
| 2696 | 0.061699 | 0.295673 | 0.624181 |
| 2698 | −0.008783 | −0.162188 | −0.319096 |
| 2699 | 0.021373 | −0.029099 | −0.143444 |
| 2700 | 0.004112 | 0.278744 | 0.204271 |
| 2707 | 0.014731 | −0.005959 | −0.192094 |
| 2750 | 0.007282 | −0.224306 | −0.335665 |
| 2769 | −0.085357 | 0.275787 | −0.772084 |
| 2772 | 0.017216 | −0.120145 | −0.343286 |
| 2775 | −0.011673 | 0.769212 | 0.451896 |
| 2810 | 0.004075 | −0.190069 | −0.240194 |
| 2811 | 0.009903 | −0.176453 | −0.085968 |
| 2813 | 0.003336 | 0.202659 | 0.191714 |
| 2815 | 0.006303 | 0.092394 | 0.150836 |
| 2824 | 0.00192 | −0.131874 | −0.166371 |
| 2835 | 0.020297 | −0.126422 | −0.206971 |
| 2856 | 0.006157 | −0.130875 | −0.287515 |
| 2864 | −0.012584 | 0.112957 | 0.202569 |
| 2865 | 0.002638 | −0.150304 | −0.265439 |
| 2868 | −0.002354 | 0.025594 | 0.276877 |
| 2873 | −0.003375 | −0.040933 | −0.559433 |
| 2891 | 0.012968 | 0.26685 | 0.212612 |
| 2897 | −0.004267 | 0.32308 | 0.463093 |
| 2905 | −0.045096 | −0.397135 | −0.859917 |
| 2926 | −0.005235 | 0.098392 | 0.200836 |
| 2931 | 0.024967 | 0.193228 | 0.410268 |
| 2936 | 0.024484 | −0.182182 | −0.112346 |
| 2938 | 0.01805 | −0.289863 | −0.273244 |
| 2946 | 0.005996 | −0.125692 | −0.084214 |
| 2964 | 0.019559 | −0.127505 | −0.385534 |
| 2965 | 0.007544 | −0.131222 | −0.15763 |
| 2972 | −0.062089 | 0.082359 | 0.199472 |
| 2973 | 0.003145 | 0.146062 | 0.413226 |
| 2976 | 0.007741 | 0.072786 | −0.299474 |
| 2981 | −0.018057 | −0.15181 | −0.335472 |
| 2995 | 0.012536 | −0.169059 | −0.090252 |
| 3004 | −0.004586 | 0.054952 | 0.213188 |
| 3014 | 0.005466 | −0.153481 | −0.203641 |
| 3022 | 0.015475 | −0.112142 | −0.208532 |
| 3059 | −0.014859 | 0.269937 | 0.241767 |
| 3079 | −0.011007 | −0.20423 | −0.516356 |
| 3085 | −0.007467 | −0.154645 | −0.263535 |
| 3094 | 0.009534 | −0.137767 | −0.14642 |
| 3105 | 0.023282 | 0.325101 | 0.254346 |
| 3120 | 0.0307 | 0.350781 | −0.241198 |
| 3130 | 0.009997 | −0.13136 | −0.143976 |
| 3132 | 0.011847 | −0.085343 | −0.251605 |
| 3161 | 0.008344 | −0.156984 | −0.187369 |
| 3185 | −0.011662 | 0.324166 | 0.476811 |
| 3194 | 0.002083 | 0.14088 | 0.284904 |
| 3211 | 0.004157 | 0.206272 | 0.386628 |
| 3214 | 0.025459 | 0.102741 | 0.240957 |
| 3215 | 0.00353 | −0.064073 | −0.167793 |
| 3228 | 0.017223 | −0.161965 | −0.0726 |
| 3237 | 0.002668 | −0.009235 | 0.21907 |
| 3245 | −0.039738 | −0.344767 | −0.512409 |
| 3269 | −0.033522 | −0.404287 | −0.588228 |
| 3279 | −0.059744 | 0.264262 | 0.389371 |
| 3288 | −0.001709 | −0.176379 | −0.380142 |
| 3328 | −0.001545 | 0.072595 | 0.2077 |
| 3337 | 0.01359 | 0.244776 | 0.208125 |
| 3338 | −0.020347 | −0.138845 | −0.506552 |
| 3341 | −0.049209 | −0.011969 | −0.419139 |
| 3356 | 0.023516 | −0.13485 | −0.110476 |
| 3357 | 0.000456 | −0.135074 | −0.091856 |
| 3380 | −0.012204 | −0.399725 | −0.454969 |
| 3387 | 0.008267 | 0.330665 | 0.191095 |
| 3390 | −0.002049 | 0.248303 | 0.32703 |
| 3395 | −0.006382 | −0.249059 | −0.201365 |
| 3402 | −0.084896 | 0.054938 | 0.463716 |
| 3416 | −0.039529 | −0.201668 | −0.578439 |
| 3420 | −0.000395 | −0.09677 | −0.20635 |
| 3423 | 0.012558 | 0.087882 | 0.242394 |
| 3426 | 0.01107 | 0.146821 | −0.432986 |
| 3443 | −0.015748 | −0.058532 | −0.400899 |
| 3444 | −0.017838 | 0.112361 | 0.21707 |
| 3470 | 0.01235 | 0.202663 | 0.425686 |
| 3473 | 0.007791 | 0.222727 | 0.486992 |
| 3477 | −0.007804 | −0.012007 | 0.180183 |
| 3496 | −0.078914 | 0.88838 | 0.619244 |
| 3516 | −0.03045 | −0.252169 | −0.485051 |
| 3522 | 0.014247 | 0.255693 | 0.387975 |
| 3549 | 0.012122 | 1.072368 | 0.652041 |
| 3560 | 0.010452 | 0.067171 | 0.167825 |
| 3569 | 0.008055 | 0.236448 | 0.463364 |
| 3571 | 0.012994 | −0.148049 | −0.087744 |
| 3579 | 0.004924 | −0.17069 | −0.122234 |
| 3585 | −0.001411 | 0.203954 | 0.124424 |
| 3594 | 0.022686 | −0.159764 | −0.113605 |
| 3595 | 0.00889 | 0.778268 | 0.724542 |
| 3627 | −0.018961 | −0.122255 | −0.455286 |
| 3649 | −0.00753 | −0.075377 | −0.245985 |
| 3655 | −0.009543 | −0.030372 | 0.280245 |
| 3658 | 0.010488 | −0.100563 | −0.316822 |
| 3662 | −0.021261 | −0.177479 | −0.164925 |
| 3678 | −0.018901 | −0.069804 | −0.40405 |
| 3689 | 0.008179 | 0.111666 | 0.212243 |
| 3715 | 0.000597 | 0.19448 | 0.237315 |
| 3720 | 0.006975 | 0.316981 | −0.554667 |
| 3724 | −0.006756 | 0.02331 | −0.392742 |

TABLE 2a-continued progression genes

| SEQ ID NO | log(ratio) CP | log(ratio) AP | log(ratio) BC |
|---|---|---|---|
| 3727 | −0.023638 | −0.142935 | −0.651747 |
| 3749 | 0.01003 | 0.043979 | 0.215776 |
| 3751 | 0.029168 | −0.073576 | −0.140182 |
| 3754 | 0.001496 | 0.107186 | 0.165913 |
| 3755 | −0.021919 | 0.195442 | 0.379175 |
| 3774 | 0.008601 | 0.081842 | 0.189429 |
| 3781 | −0.027603 | −0.124679 | −0.389211 |
| 3795 | −0.009508 | −0.235417 | −0.340756 |
| 3848 | 0.008156 | −0.137025 | −0.091425 |
| 3853 | 0.00189 | −0.145487 | −0.229147 |
| 3854 | −0.009932 | −0.323309 | −0.627916 |
| 3865 | −0.006782 | 0.081835 | 0.099887 |
| 3869 | 0.026028 | −0.164373 | −0.08952 |
| 3874 | 0.002977 | 0.004837 | −0.354182 |
| 3878 | −0.00536 | −0.135863 | −0.293698 |
| 3908 | 0.01371 | −0.080601 | −0.140019 |
| 3938 | 0.005563 | −0.114606 | −0.098469 |
| 3941 | 0.018012 | 0.177639 | 0.090444 |
| 3955 | −0.019735 | −0.159647 | −0.33003 |

TABLE 2b progression genes

| SEQ ID NO | log(ratio) CP | log(ratio) AP | log(ratio) BC |
|---|---|---|---|
| 3925 | 0.003797 | −0.153433 | −0.114664 |

Table 3 lists the "top ten" genes that are associated with progression and response, independent of normal CD34+ expression, based on log 10 ratio of expression compared to the chronic phase pool. These genes are identified by their SEQ ID NOs in Table 3. Information for these genes is presented in Table 8.

TABLE 3

"top ten" genes

| SEQ ID NO | log(ratio) CP | log(ratio) AP | log(ratio) BC | REGULATION |
|---|---|---|---|---|
| 902 | 0 | 0 | 0.599663 | up |
| 984 | 0 | 0 | −0.77846 | down |
| 1334 | 0 | 0 | −0.94289 | down |
| 1756 | 0 | 0 | −0.78849 | down |
| 1813 | 0 | 0 | −0.85091 | down |
| 1973 | 0 | 0 | −0.79673 | down |
| 2056 | 0 | 0 | −1.01514 | down |
| 2211 | 0 | 0 | −0.82401 | down |
| 2561 | 0 | 0 | 0.686131 | up |
| 2810 | 0 | 0 | −0.85992 | down |
| 2813 | 0 | 0 | 0.652041 | up |
| 2815 | 0 | 0 | 0.816212 | up |
| 2824 | 0 | 0 | −1.14209 | down |
| 2864 | 0 | 0 | 0.651561 | up |
| 2973 | 0 | 0 | 0.746645 | up |
| 3085 | 0 | 0 | −0.85537 | down |
| 3211 | 0 | 0 | 0.617251 | up |
| 3477 | 0 | 0 | 0.619244 | up |
| 3749 | 0 | 0 | 0.703125 | up |
| 3941 | 0 | 0 | 0.659891 | up |

Table 4 lists a set of 228 genes associated with imatinib resistance (the "imatinib resistance genes"). The imatinib resistance genes are identified by their SEQ ID NOs in Table 4. Information for these genes is presented in Table 8. Table 4 also listed for each gene the log ratio of expression level of the gene in samples from patients of a particular phase (e.g., CP, AP, or BC) or IM resistance (IM) versus expression level of the gene in a pool of CML bone marrow samples from chronic phase patients. Each log ratio column thus contains expression levels of markers for a particular phase or IM resistance.

TABLE 4 genes associated with imatinib resistance

| SEQ ID NO | log(ratio) CP | log(ratio) AP | log(ratio) BC | log(ratio) IM |
|---|---|---|---|---|
| 20 | 0 | 0 | −0.38709 | 0.263887 |
| 28 | 0 | 0 | −0.01912 | 0.265124 |
| 50 | 0 | 0 | 0.04967 | 0.383703 |
| 72 | 0 | 0 | −0.03184 | 0.248668 |
| 77 | 0 | 0 | −0.1097 | 0.230979 |
| 91 | 0 | 0 | −0.21363 | 0.302135 |
| 93 | 0 | 0 | 0.012872 | 0.248989 |
| 97 | 0 | 0 | 0.084015 | 0.441542 |
| 124 | 0 | 0 | 0.230888 | 0.535462 |
| 134 | 0 | 0 | −0.03703 | 0.179006 |
| 150 | 0 | 0 | −0.0693 | 0.172068 |
| 155 | 0 | 0 | −0.13679 | 0.157108 |
| 171 | 0 | 0 | 0.196959 | 0.633551 |
| 195 | 0 | 0 | 0.02123 | 0.207227 |
| 243 | 0 | 0 | 0.11112 | 0.695707 |
| 254 | 0 | 0 | −0.08112 | 0.269401 |
| 269 | 0 | 0 | −0.03573 | 0.298949 |
| 275 | 0 | 0 | −0.15251 | 0.212305 |
| 283 | 0 | 0 | −0.03596 | 0.21647 |
| 292 | 0 | 0 | 0.20614 | 0.549719 |
| 342 | 0 | 0 | 0.208194 | 0.677793 |
| 371 | 0 | 0 | −0.06027 | 0.449786 |
| 372 | 0 | 0 | −0.02106 | 0.351234 |
| 377 | 0 | 0 | −0.16901 | 0.161438 |
| 386 | 0 | 0 | −0.07531 | 0.180776 |
| 406 | 0 | 0 | −0.06767 | 0.371699 |
| 426 | 0 | 0 | −0.05036 | 0.281576 |
| 442 | 0 | 0 | −0.14473 | 0.198718 |
| 456 | 0 | 0 | −0.05428 | 0.215394 |
| 459 | 0 | 0 | −0.03202 | 0.345771 |
| 469 | 0 | 0 | −0.18903 | 0.227286 |
| 480 | 0 | 0 | 0.038217 | 0.684655 |
| 531 | 0 | 0 | −0.17195 | 0.414879 |
| 568 | 0 | 0 | −0.06414 | 0.098452 |
| 622 | 0 | 0 | −0.40798 | 0.833497 |
| 662 | 0 | 0 | −0.00884 | 0.217496 |
| 663 | 0 | 0 | −0.09438 | 0.107198 |
| 670 | 0 | 0 | −0.17245 | 0.1338 |
| 709 | 0 | 0 | 0.187456 | 0.553818 |
| 722 | 0 | 0 | −0.11073 | 0.162124 |
| 768 | 0 | 0 | −0.10115 | 0.42413 |
| 785 | 0 | 0 | 0.219511 | 0.690758 |
| 796 | 0 | 0 | −0.12656 | 0.145981 |
| 856 | 0 | 0 | −0.01924 | 0.400575 |
| 880 | 0 | 0 | −0.10236 | 0.278475 |
| 894 | 0 | 0 | −0.02732 | 0.206984 |
| 917 | 0 | 0 | −0.25561 | 0.212912 |
| 924 | 0 | 0 | 0.224269 | 0.708077 |
| 973 | 0 | 0 | −0.01275 | 0.730765 |
| 977 | 0 | 0 | −0.10317 | 0.400818 |
| 980 | 0 | 0 | −0.1785 | 0.286644 |
| 1008 | 0 | 0 | −0.10928 | 0.108172 |
| 1014 | 0 | 0 | 0.148244 | 0.865065 |
| 1023 | 0 | 0 | 0.098335 | 0.878985 |
| 1037 | 0 | 0 | −0.33476 | 0.837053 |
| 1038 | 0 | 0 | −0.20627 | 0.621468 |
| 1052 | 0 | 0 | −0.2069 | 0.236861 |
| 1059 | 0 | 0 | 0.148036 | 0.402311 |
| 1074 | 0 | 0 | −0.33264 | 0.239842 |
| 1089 | 0 | 0 | 0.174284 | 0.985452 |
| 1095 | 0 | 0 | 0.304656 | 0.927005 |
| 1124 | 0 | 0 | −0.07093 | 0.616113 |
| 1143 | 0 | 0 | −0.18175 | 0.201291 |
| 1157 | 0 | 0 | −0.18174 | 0.21747 |
| 1170 | 0 | 0 | −0.08377 | 0.431166 |
| 1173 | 0 | 0 | −0.09515 | 0.560044 |
| 1182 | 0 | 0 | −0.45446 | 0.142546 |
| 1190 | 0 | 0 | 0.041007 | 0.359776 |
| 1215 | 0 | 0 | −0.06781 | 0.83596 |
| 1219 | 0 | 0 | −0.07224 | 0.165806 |
| 1224 | 0 | 0 | −0.05776 | 0.205308 |

TABLE 4-continued genes associated with imatinib resistance

| SEQ ID NO | log(ratio) CP | log(ratio) AP | log(ratio) BC | log(ratio) IM |
|---|---|---|---|---|
| 1247 | 0 | 0 | −0.08694 | 0.185421 |
| 1249 | 0 | 0 | 0.263515 | 0.605748 |
| 1267 | 0 | 0 | 0.263464 | 1.063745 |
| 1323 | 0 | 0 | −0.2206 | 0.10102 |
| 1329 | 0 | 0 | −0.00537 | 0.436924 |
| 1331 | 0 | 0 | −0.01409 | 0.755256 |
| 1336 | 0 | 0 | −0.15667 | 0.34331 |
| 1367 | 0 | 0 | −0.3207 | 0.489696 |
| 1379 | 0 | 0 | −0.17026 | 0.205201 |
| 1389 | 0 | 0 | 0.079937 | 0.359209 |
| 1435 | 0 | 0 | 0.092179 | 0.722108 |
| 1449 | 0 | 0 | −0.467 | 0.171956 |
| 1451 | 0 | 0 | 0.425181 | 0.859676 |
| 1478 | 0 | 0 | −0.152 | 0.122073 |
| 1482 | 0 | 0 | 0.111952 | 0.395553 |
| 1494 | 0 | 0 | −0.16752 | 0.177726 |
| 1526 | 0 | 0 | −0.15569 | 0.166092 |
| 1534 | 0 | 0 | 0.10057 | 0.802351 |
| 1549 | 0 | 0 | −0.01958 | 0.262207 |
| 1566 | 0 | 0 | −0.07228 | 0.314048 |
| 1591 | 0 | 0 | 0.253125 | 0.761339 |
| 1657 | 0 | 0 | −0.02703 | 0.334287 |
| 1671 | 0 | 0 | −0.13532 | 0.128801 |
| 1708 | 0 | 0 | −0.03956 | 0.206351 |
| 1709 | 0 | 0 | 0.265264 | 0.510844 |
| 1731 | 0 | 0 | −0.16089 | 0.119466 |
| 1789 | 0 | 0 | −0.28125 | 0.246382 |
| 1820 | 0 | 0 | −0.42872 | 0.604742 |
| 1839 | 0 | 0 | −0.01985 | 0.652489 |
| 1840 | 0 | 0 | 0.057241 | 0.774482 |
| 1898 | 0 | 0 | −0.39467 | 0.378527 |
| 1948 | 0 | 0 | 0.082745 | 0.793455 |
| 1949 | 0 | 0 | −0.18208 | 0.868135 |
| 1959 | 0 | 0 | −0.22455 | 0.344545 |
| 1965 | 0 | 0 | −0.26522 | 0.569866 |
| 2012 | 0 | 0 | −0.35247 | 0.31479 |
| 2033 | 0 | 0 | 0.040006 | 0.345342 |
| 2073 | 0 | 0 | 0.039277 | 0.877752 |
| 2081 | 0 | 0 | −0.05539 | 0.149592 |
| 2087 | 0 | 0 | −0.29516 | 0.404949 |
| 2088 | 0 | 0 | −0.02581 | 0.326797 |
| 2106 | 0 | 0 | −0.23592 | 0.332507 |
| 2126 | 0 | 0 | −0.02439 | 0.515267 |
| 2145 | 0 | 0 | −0.2559 | 0.725553 |
| 2151 | 0 | 0 | −0.01135 | 0.414351 |
| 2172 | 0 | 0 | −0.08199 | 0.39351 |
| 2178 | 0 | 0 | −0.26619 | 0.102312 |
| 2181 | 0 | 0 | −0.06055 | 0.158135 |
| 2183 | 0 | 0 | 0.223605 | 0.977949 |
| 2189 | 0 | 0 | 0.216936 | 1.068883 |
| 2199 | 0 | 0 | −0.27714 | 0.840265 |
| 2207 | 0 | 0 | −0.29681 | 0.440807 |
| 2228 | 0 | 0 | −0.05689 | 0.930733 |
| 2244 | 0 | 0 | −0.37335 | 0.576383 |
| 2269 | 0 | 0 | −0.17482 | 0.171115 |
| 2285 | 0 | 0 | −0.05323 | 0.923962 |
| 2286 | 0 | 0 | −0.11188 | 0.142335 |
| 2289 | 0 | 0 | −0.31747 | 0.354229 |
| 2292 | 0 | 0 | 0.437319 | 0.959855 |
| 2354 | 0 | 0 | −0.06186 | 0.222863 |
| 2387 | 0 | 0 | −0.60522 | 0.324344 |
| 2388 | 0 | 0 | −0.11786 | 0.725499 |
| 2408 | 0 | 0 | 0.27178 | 0.449011 |
| 2427 | 0 | 0 | −0.0812 | 0.174195 |
| 2437 | 0 | 0 | 0.027895 | 1.082811 |
| 2449 | 0 | 0 | 0.012028 | 0.297163 |
| 2479 | 0 | 0 | −0.22582 | 0.179989 |
| 2492 | 0 | 0 | −0.25009 | 0.349156 |
| 2531 | 0 | 0 | 0.07276 | 0.662312 |
| 2545 | 0 | 0 | 0.021603 | 0.945236 |
| 2553 | 0 | 0 | −0.01276 | 0.395767 |
| 2564 | 0 | 0 | −0.28345 | 0.250146 |
| 2568 | 0 | 0 | −0.10977 | 0.19616 |
| 2582 | 0 | 0 | 0.253015 | 0.634172 |
| 2615 | 0 | 0 | 0.128864 | 1.013705 |
| 2618 | 0 | 0 | −0.2905 | 0.559533 |
| 2629 | 0 | 0 | −0.06243 | 0.410775 |
| 2633 | 0 | 0 | −0.41692 | 0.392893 |
| 2652 | 0 | 0 | 0.205031 | 0.647252 |
| 2653 | 0 | 0 | −0.00396 | 0.377357 |
| 2660 | 0 | 0 | −0.53433 | 0.393617 |
| 2665 | 0 | 0 | 0.062554 | 0.686441 |
| 2666 | 0 | 0 | 0.017231 | 0.276612 |
| 2686 | 0 | 0 | 0.074055 | 0.352962 |
| 2697 | 0 | 0 | 0.142879 | 0.722647 |
| 2756 | 0 | 0 | 0.033883 | 0.281303 |
| 2780 | 0 | 0 | −0.43199 | 0.457222 |
| 2802 | 0 | 0 | 0.032077 | 0.248953 |
| 2807 | 0 | 0 | 0.088818 | 0.865409 |
| 2828 | 0 | 0 | 0.375805 | 0.936957 |
| 2844 | 0 | 0 | −0.10182 | 0.193285 |
| 2879 | 0 | 0 | −0.11063 | 0.376181 |
| 2896 | 0 | 0 | −0.12602 | 0.433851 |
| 2942 | 0 | 0 | 0.038329 | 0.261638 |
| 2955 | 0 | 0 | 0.337985 | 0.616413 |
| 2977 | 0 | 0 | 0.006318 | 0.640784 |
| 2980 | 0 | 0 | −0.06256 | 0.752042 |
| 2984 | 0 | 0 | −0.0839 | 0.535325 |
| 2989 | 0 | 0 | −0.04767 | 0.23291 |
| 2994 | 0 | 0 | −0.12413 | 0.24541 |
| 3004 | 0 | 0 | −0.22221 | 0.402371 |
| 3015 | 0 | 0 | −0.38468 | 0.767185 |
| 3040 | 0 | 0 | −0.15874 | 0.553807 |
| 3051 | 0 | 0 | −0.16014 | 0.258388 |
| 3095 | 0 | 0 | −0.23449 | 0.453399 |
| 3145 | 0 | 0 | 0.046709 | 0.349592 |
| 3149 | 0 | 0 | −0.07479 | 0.13184 |
| 3172 | 0 | 0 | −0.09216 | 0.235379 |
| 3178 | 0 | 0 | −0.16051 | 0.189495 |
| 3181 | 0 | 0 | −0.18123 | 0.657828 |
| 3183 | 0 | 0 | −0.08563 | 0.644291 |
| 3234 | 0 | 0 | −0.09319 | 0.622993 |
| 3239 | 0 | 0 | −0.15225 | 0.543178 |
| 3263 | 0 | 0 | −0.09885 | 0.51508 |
| 3267 | 0 | 0 | −0.0802 | 0.247087 |
| 3272 | 0 | 0 | −0.06519 | 0.20193 |
| 3284 | 0 | 0 | −0.39928 | 0.564677 |
| 3317 | 0 | 0 | 0.042257 | 0.663222 |
| 3324 | 0 | 0 | −0.0387 | 0.202691 |
| 3334 | 0 | 0 | −0.14218 | 0.402162 |
| 3342 | 0 | 0 | 0.094368 | 0.377785 |
| 3360 | 0 | 0 | −0.18153 | 0.352019 |
| 3370 | 0 | 0 | −0.07291 | 0.154629 |
| 3373 | 0 | 0 | 0.266208 | 1.01143 |
| 3378 | 0 | 0 | 0.154822 | 0.471737 |
| 3389 | 0 | 0 | 0.096215 | 0.292369 |
| 3402 | 0 | 0 | 0.166222 | 0.929501 |
| 3433 | 0 | 0 | −0.08958 | 0.164089 |
| 3476 | 0 | 0 | −0.02612 | 0.185903 |
| 3479 | 0 | 0 | −0.23806 | 0.307206 |
| 3482 | 0 | 0 | 0.017378 | 0.267581 |
| 3546 | 0 | 0 | 0.071637 | 0.321201 |
| 3554 | 0 | 0 | −0.10865 | 0.21563 |
| 3620 | 0 | 0 | −0.18183 | 0.230787 |
| 3632 | 0 | 0 | 0.04804 | 0.247622 |
| 3677 | 0 | 0 | −0.14473 | 0.201314 |
| 3683 | 0 | 0 | 0.00301 | 0.2633 |
| 3686 | 0 | 0 | −0.03852 | 0.375431 |
| 3692 | 0 | 0 | −0.59334 | 0.407906 |
| 3711 | 0 | 0 | −0.07697 | 0.1336 |
| 3725 | 0 | 0 | −0.1157 | 0.688963 |
| 3746 | 0 | 0 | −0.09686 | 0.406243 |
| 3765 | 0 | 0 | −0.38459 | 0.568063 |
| 3785 | 0 | 0 | −0.02761 | 0.586677 |
| 3793 | 0 | 0 | −0.01682 | 0.432956 |
| 3800 | 0 | 0 | 0.093978 | 0.693084 |
| 3804 | 0 | 0 | 0.149344 | 0.963817 |
| 3812 | 0 | 0 | 0.078875 | 0.719019 |
| 3836 | 0 | 0 | 0.245725 | 0.62927 |
| 3876 | 0 | 0 | −0.10377 | 0.245747 |
| 3891 | 0 | 0 | 0.056743 | 0.30804 |
| 3905 | 0 | 0 | −0.18947 | 0.77305 |

TABLE 4-continued genes associated with imatinib resistance

| SEQ ID NO | log(ratio) CP | log(ratio) AP | log(ratio) BC | log(ratio) IM |
|---|---|---|---|---|
| 3935 | 0 | 0 | −0.1837 | 0.688495 |
| 3939 | 0 | 0 | −0.13203 | 0.177443 |
| 3946 | 0 | 0 | −0.57596 | 0.119957 |
| 3966 | 0 | 0 | −0.14854 | 0.290791 |

Tables 5a and 5b list 386 target genes, which are differentially expressed between CML blast crisis and normal immature CD34+ cells (p<0.1%) (the "target geneset"). The target genes are identified by their SEQ ID NOs in Tables 5a and 5b. Information for these genes is presented in Table 8. Table 5a lists target genes that that were not disclosed in U.S. Patent Application Publication 2003/01044026 A1, dated Jun. 5, 2003. Table 5b lists target genes that were also identified in U.S. Patent Application Publication 2003/01044026 A1, dated Jun. 5, 2003.

TABLE 5a

CML target genes SEQ ID NO 2
8
51
74
88
99
105
109
116
142
146
158
174
184
185
191
204
246
252
261
267
298
309
312
321
337
343
359
365
370
379
390
393
432
444
483
490
493
494
495
503
506
522
562
564
565
571
576
596
600
602

TABLE 5a-continued

CML target genes SEQ ID NO 605
607
615
628
629
631
638
644
659
664
665
675
676
688
700
701
727
728
730
741
745
759
766
781
788
790
809
813
843
840
841
845
847
873
878
884
900
902
906
908
915
934
960
962
983
1000
1012
1014
1020
1027
1036
1051
1054
1067
1089
1093
1106
1112
1132
1138
1140
1145
1158
1160
1161
1164
1165
1183
1188
1197
1202
1223
1245
1254
1288
1300
1306

TABLE 5a-continued

| CML target genes SEQ ID NO |
|---|
| 1308 |
| 1311 |
| 1325 |
| 1331 |
| 1334 |
| 1346 |
| 1352 |
| 1380 |
| 1400 |
| 1409 |
| 1410 |
| 1411 |
| 1415 |
| 1416 |
| 1440 |
| 1441 |
| 1446 |
| 1452 |
| 1456 |
| 1464 |
| 1472 |
| 1489 |
| 1495 |
| 1500 |
| 1502 |
| 1503 |
| 1522 |
| 1527 |
| 1532 |
| 1534 |
| 1575 |
| 1596 |
| 1608 |
| 1614 |
| 1643 |
| 1652 |
| 1674 |
| 1689 |
| 1711 |
| 1712 |
| 1713 |
| 1724 |
| 1728 |
| 1756 |
| 1757 |
| 1762 |
| 1767 |
| 1772 |
| 1781 |
| 1785 |
| 1798 |
| 1799 |
| 1800 |
| 1802 |
| 1803 |
| 1813 |
| 1828 |
| 1849 |
| 1870 |
| 1873 |
| 1893 |
| 1910 |
| 1926 |
| 1927 |
| 1944 |
| 1990 |
| 1991 |
| 1998 |
| 2007 |
| 2011 |
| 2023 |
| 2032 |
| 2040 |
| 2042 |
| 2056 |
| 2064 |
| 2082 |

TABLE 5a-continued

| CML target genes SEQ ID NO |
|---|
| 2085 |
| 2101 |
| 2104 |
| 2136 |
| 2161 |
| 2162 |
| 2174 |
| 2188 |
| 2200 |
| 2206 |
| 2211 |
| 2212 |
| 2213 |
| 2218 |
| 2224 |
| 2248 |
| 2252 |
| 2253 |
| 2266 |
| 2279 |
| 2304 |
| 2310 |
| 2312 |
| 2313 |
| 2320 |
| 2329 |
| 2356 |
| 2372 |
| 2388 |
| 2406 |
| 2442 |
| 2454 |
| 2462 |
| 2469 |
| 2479 |
| 2505 |
| 2525 |
| 2534 |
| 2554 |
| 2561 |
| 2563 |
| 2565 |
| 2567 |
| 2591 |
| 2600 |
| 2631 |
| 2632 |
| 2649 |
| 2654 |
| 2658 |
| 2664 |
| 2665 |
| 2670 |
| 2676 |
| 2696 |
| 2699 |
| 2721 |
| 2726 |
| 2734 |
| 2739 |
| 2766 |
| 2775 |
| 2777 |
| 2788 |
| 2810 |
| 2824 |
| 2825 |
| 2830 |
| 2842 |
| 2862 |
| 2863 |
| 2864 |
| 2892 |
| 2894 |
| 2900 |
| 2903 |
| 2921 |

TABLE 5a-continued

CML target genes
SEQ ID NO 2928
2938
2953
2964
2967
2981
3003
3019
3020
3027
3029
3047
3048
3067
3075
3085
3093
3094
3097
3103
3136
3185
3191
3194
3196
3215
3222
3238
3240
3241
3245
3248
3254
3279
3312
3329
3339
3348
3361
3364
3373
3380
3395
3396
3398
3400
3402
3428
3456
3462
3470
3500
3514
3533
3538
3555
3569
3582
3583
3611
3628
3640
3642
3646
3650
3655
3658
3685
3689
3696
3718
3755
3763
3792
3844
3845
3849
3857
3880
3901
3915
3937
3940
3955

TABLE 5b

CML target genes

| SEQ ID NO | log(ratio) BC |
|---|---|
| 1776 | 0 |
| 3961 | 0 |

Genes that are not listed in Table 1a or 1b but which are functional equivalents of any gene listed in Table 1a or 1b can also be used with or in place of the gene listed in the table. A functional equivalent of a gene A refers to a gene that encodes a protein or mRNA that at least partially overlaps in physiological function in the cell to that of the protein or mRNA of gene A.

In various specific embodiments, different numbers and subcombinations of the genes listed in Tables 1a and/or 1b are selected as the marker set, whose profile is used in the methods of the invention, as described in Section 5.2., infra. In various embodiments, all or a subset of those genes listed in each of Tables 2a and/or 2b or Table 3, supra, or their respective functional equivalents are used.

In one embodiment, one or more genes that cluster together with one or more genes listed in a table can be selected to represent the cluster such that the marker set contains genes representing a plurality of different clusters.

In a specific embodiment, measurements of gene products of the genes, respectively, shown in Tables 2a and/or 2b, or their respective functional equivalents, are used for CML progression evaluation. In a particular embodiment, measurements of gene products of all or at least 5, 10, 15, 20, 25, 30, 40, 50, 60, 70, 80, 90, 100 or 200 of the genes listed in Tables 2a and/or 2b are used.

In another embodiment, measurements of the gene products of the set of 20 genes shown in Table 3 (which is a subset of the genes listed in Table 2a and Table 5a) or their respective functional equivalents are used CML progression evaluation. In a particular embodiment, measurements of gene products of all or at least 5, 10, 15 or 20 of the genes listed in Table 3 are used.

In another embodiment, measurements of the gene products of the set of 10 up-regulated genes shown in Table 3 or their respective functional equivalents are used CML progression evaluation. In a particular embodiment, measurements of gene products of all or at least 5, 6, 7, 8, 9 or all 10 of the up-regulated genes listed in Table 3 are used.

In another embodiment, measurements of the gene products of the set of 10 down-regulated genes shown in Table 3 or their respective functional equivalents are used CML progression evaluation. In a particular embodiment, measurements of gene products of all or at least 5, 6, 7, 8, 9 or all 10 of the down-regulated genes listed in Table 3 are used.

In still another embodiment, measurements of the genes, respectively, shown in Table 4 or their respective functional equivalents are used for determining imatinib resistance in a patient. In a particular embodiment, measurements of gene products of all or at least 5, 10, 15, 20, 25, 30, 40, 50, 60, 70, 80, 90, 100 or 200 of the genes listed in Table 4 are used. In a specific embodiment, imatinib resistance is determined according to the measurements of gene products of all or at least 5, 6, 7, or 8 of the genes selected from the group consisting of serine threonine kinases CTRL, MAP21K14, CLK3, MAP kinase MKNK2, the tyrosine kinase oncogene FYN, TCF7 (a putatively T cell specific transcription factor), guanine nucleotide binding proteins GNAZ and GNG11, and the MAF.

The invention also provides sets of promoter controlled genes, measurements of which can be used for evaluating the progression of CML in a patient. In one embodiment, measurements of the gene products of genes that are controlled by one or more of the promoters shown in Table 6 or their respective functional equivalents are used for evaluating CML progression. In a particular embodiment, measurements of gene products controlled by a promoter selected from the group consisting of set of promoters shown in Table 6 or their respective functional equivalents are used.

TABLE 6

Promoters associated with CML progression

| PROMOTER | P-VALUE | EXPECTA-TION | SOURCE | SPECIES |
|---|---|---|---|---|
| MZF_1-4 | 0 | 0 | Genes with common promoter sites | *Homo sapiens* |
| S8 | 1.22E−12 | 7.69E−11 | Genes with common promoter sites | *Homo sapiens* |
| deltaEF1 | 5.87E−11 | 3.70E−09 | Genes with common promoter sites | *Homo sapiens* |
| SPI-B | 1.48E−10 | 9.35E−09 | Genes with common promoter sites | *Homo sapiens* |
| Yin-Yang | 1.48E−09 | 9.30E−08 | Genes with common promoter sites | *Homo sapiens* |
| Ahr-ARNT | 1.60E−09 | 1.01E−07 | Genes with common promoter sites | *Homo sapiens* |
| MZF_5-13 | 1.26E−06 | 7.96E−05 | Genes with common promoter sites | *Homo sapiens* |
| c-MYB_1 | 5.10E−06 | 0.000321 | Genes with common promoter sites | *Homo sapiens* |

The invention provides methods for identifying a set of genes for evaluating stage/progression of CML. The methods make use of measured expression profiles of a plurality of genes (e.g., measurements of abundance levels of the corresponding gene products) in bone marrow or blood samples from a plurality of patients whose CML stage/progression status are known. As used herein, a patient is animal inflicted with CML. The patient can be but is not limited to a human, or, in a veterinary context, from non-human animals such as ruminants, horses, swine or sheep, or from domestic companion animals such as felines and canines. In one embodiment, for each of the plurality of genes a metric of correlation between expression level of the gene and survival outcome in the plurality of CML patients is determined. One or more genes are then selected based on their metrics of correlation.

Progression markers can be obtained by identifying genes whose expression levels are significantly different across CML patients of different phases of CML. In preferred embodiments, genes whose expression levels exhibit differences across different phrase groups to at least a predetermined level are selected as the genes whose expression levels correlate with CML phases. In one embodiment, the expression level differences among patients of different CML phases are evaluated using ANOVA. In one embodiment, a gene is selected if the p-value of the gene corresponds to a predetermined significance level, e.g., a p-value less than $10^{-11}$.

The invention also provides a computer system comprising a processor, and a memory coupled to said processor and encoding one or more programs, wherein said one or more programs cause the processor to carry out a method described above.

The invention also provides a computer program product for use in conjunction with a computer having a processor and a memory connected to the processor, said computer program product comprising a computer readable storage medium having a computer program mechanism encoded thereon, wherein said computer program mechanism may be loaded into the memory of said computer and cause said computer to carry out a method described above.

5.2. Methods of Evaluating CML Progression and Responses

The invention provides methods for determining the stage or progression status in a CML patient using a measured marker profile comprising measurements of the gene products of genes, e.g., the sets of genes described in Section 5.1., supra.

5.2.1. Methods for Evaluating Progression Based On Expression Profiles

In preferred embodiments, the methods of the invention use a progression classifier, also called a classifier, for predicting CML progression and/or responsiveness to imatinib mesylate in a patient. The progression classifier can be based on any appropriate pattern recognition method that receives an input comprising a marker profile and provides an output comprising data indicating which phase the patient belongs. The progression classifier can be trained with training data from a training population of CML patients. Typically, the training data comprise for each of the CML patients in the training population a training marker profile comprising measurements of respective gene products of a plurality of genes in a suitable sample taken from the patient and CML progression information. In a preferred embodiment, the training population comprises patients from each of the different stages of CML, i.e., CP-CML, ADV-CML, or AP-CML and BC-CML. In another preferred embodiment, the training population comprises patients from each of the different IM response groups, i.e., IM resistant and IM responsive.

In preferred embodiments, the progression classifier can be based on a classification (pattern recognition) method described below, e.g., profile similarity (Section 5.2.1.1., infra); artificial neural network (Section 5.2.1.2., infra); support vector machine (SVM, Section 5.2.1.3., infra); logic regression (Section 5.2.1.4., infra), linear or quadratic discriminant analysis (Section 5.2.1.5., infra), decision trees (Section 5.2.1.6., infra), clustering (Section 5.2.1.7., infra), principal component analysis (Section 5.2.1.8., infra), nearest neighbor classifier analysis (Section 5.2.1.9., infra). Such progression classifiers can be trained with the training population using methods described in the relevant sections, infra.

The marker profile can be obtained by measuring the plurality of gene products in a CML cell sample from the patient using a method known in the art, e.g., a method described in Section 5.2.4-5.2.5., infra.

Various known statistical pattern recognition methods can be used in conjunction with the present invention. A progression classifier based on any of such methods can be constructed using the marker profiles and progression data of training patients. Such a progression classifier can then be used to evaluate the progression status of a CML patient based on the patient's marker profile. The methods can also be used to identify markers that discriminate between different progression status and/or imatinib resistance using a marker profile and progression and/or imatinib resistance data of training patients. For simplicity, the methods are often discussed with respect to evaluation of the progression status. It will be understood by a person skilled in the art that the methods are equally applicable to evaluation of IM responsiveness.

5.2.1.1. Profile Matching

A patient's CML stage or progression status can be evaluated by comparing a marker profile obtained in a suitable sample from the patient with a marker profile that is representative of a particular CML phase. Such a marker profile is also termed a "template profile" or a "template." The degree of similarity to such a template profile provides an evaluation of the patient's CML stage or progression status. If the degree of similarity of the patient marker profile and a template profile is above a predetermined threshold, the patient is assigned a CML phase or progression status represented by the template. For example, a patient's CML stage or progression status can be evaluated by comparing a marker profile of the patient to a predetermined template profile corresponding to a certain CML stage or progression status, e.g., an ADV-CML template comprising measurements of the plurality of markers which are representative of levels of the markers in a plurality of advanced phase patients or a CP-CML template comprising measurements of the plurality of markers which are representative of levels of the markers in a plurality of chronic phase patients.

In one embodiment, the similarity is represented by a correlation coefficient between the patient's profile and the template. In one embodiment, a correlation coefficient above a correlation threshold indicates a high similarity, whereas a correlation coefficient below the threshold indicates a low similarity.

In a specific embodiment, $P_i$ measures the similarity between the patient's profile $\vec{y}$ and a template profile, e.g., a template profile comprising measurements of marker gene products representative of measurements of marker gene products of a level of progression of CML, e.g., the CP-CML template $\vec{z}_{CP}$ or the ADV-CML template $\vec{z}_{ADV}$. Such a coefficient, $P_i$, can be calculated using the following equation:

$$P_i = (\vec{z}_i \cdot \vec{y})/(\|\vec{z}_i\| \cdot \|\vec{y}\|)$$

where i designates the ith template. For example, i is CP for CP-CML template. Thus, in one embodiment, $\vec{y}$ is classified as a CP-CML profile if $P_{CP}$ is greater than a selected correlation threshold. In another embodiment, $\vec{y}$ is classified as an ADV-CML profile if $P_{ADV}$ is greater than a selected correlation threshold. In preferred embodiments, the correlation threshold is set as 0.3, 0.4, 0.5 or 0.6. In another embodiment, $\vec{y}$ is classified as a CP-CML profile if $P_{CP}$ is greater than $P_{ADV}$, whereas $\vec{y}$ is classified as a ADV-CML profile if $P_{CP}$ is less than $P_{ADV}$.

In another embodiment, the correlation coefficient is a weighted dot product of the patient's profile $\vec{y}$ and a template profile, in which measurements of each different marker is assigned a weight.

In another embodiment, similarity between a patient's profile and a template is represented by a distance between the patient's profile and the template. In one embodiment, a distance below a given value indicates high similarity, whereas a distance equal to or greater than the given value indicates low similarity.

In one embodiment, the Euclidian distance according to the formula $$D_i = \|\vec{y} - \vec{z}_i\|$$

is used, where $D_i$ measures the distance between the patient's profile $\vec{y}$ and a template profile comprising measurements of marker gene products representative of measurements of marker gene products of a level of progression of CML, e.g., the CP-CML template $\vec{z}_{CP}$, the ADV-CML template $\vec{z}_{ADV}$ or the AP-CML template $\vec{z}_{AP}$ or BC-CML template $\vec{z}_{BC}$. In other embodiments, the Euclidian distance is squared to place progressively greater weight on cellular constituents that are further apart. In alternative embodiments, the distance measure $D_i$ is the Manhattan distance provide by $$D_i = \sum_n |y(n) - z_i(n)|$$

where y(n) and $z_i$(n) are respectively measurements of the nth marker gene product in the patient's profile $\vec{y}$ and a template profile.

In another embodiment, the distance is defined as $D_i = 1 - P_i$, where $P_i$ is the correlation coefficient or normalized dot product as described above.

In still other embodiments, the distance measure may be the Chebychev distance, the power distance, and percent disagreement, all of which are well known in the art.

A distance based similarity measure is particularly useful for classifying advanced phase CML patients as either AP-CML or BC-CML since the marker profiles of AP-CML and BC-CML differ from each other in a quantitative rather than qualitative manner. Thus, in one embodiment, the invention provides a method for classifying an advanced phase CML patient as either AP-CML or BC-CML by comparing the distances between a marker profile of the patient with an AP-CML template and a BC-CML template, and classifying the patient as either AP-CML or BC-CML if the distance to the corresponding template is smaller.

A person skilled in the art would understand that the above described methods can be applied to expression profiles of IM resistance genes for evaluation of IM responsiveness. For example, the methods can be used to compare a patient expression profile to IM resistance template and IM responsive template by calculating a $P_i$ measuring the similarity between the patient's profile $\vec{y}$ and the IM resistance template comprising measurements of marker gene products representative of measurements of marker gene products in IM resistant patients, $\vec{z}_{resist}$, and/or IM responsive template comprising measurements of marker gene products representative of measurements of marker gene products in IM responsive patients, $\vec{z}_{resp}$. Such a coefficient, $P_i$, can be calculated using the equation described above.

5.2.1.2. Artificial Neural Network

In some embodiments, a neural network is used to classify a patient marker profile. The neural network takes the patient marker profile as an input and generates an output comprising the progression status and/or IM responsiveness. A neural network can be constructed for a selected set of molecular markers of the invention. A neural network is a two-stage regression or classification model. A neural network has a layered structure that includes a layer of input units (and the bias) connected by a layer of weights to a layer of output units. For regression, the layer of output units typically includes just one output unit. However, neural networks can handle multiple quantitative responses in a seamless fashion.

In multilayer neural networks, there are input units (input layer), hidden units (hidden layer), and output units (output layer). There is, furthermore, a single bias unit that is connected to each unit other than the input units. Neural networks are described in Duda et al., 2001, *Pattern Classification*, Second Edition, John Wiley & Sons, Inc., New York; and Hastie et al., 2001, *The Elements of Statistical Learning*, Springer-Verlag, New York.

The basic approach to the use of neural networks is to start with an untrained network, present a training pattern, e.g., marker profiles from training patients, to the input layer, and to pass signals through the net and determine the output, e.g., the status of progression and/or the status of imatinib resistance in the training patients, at the output layer. These outputs are then compared to the target values; any difference corresponds to an error. This error or criterion function is some scalar finction of the weights and is minimized when the network outputs match the desired outputs. Thus, the weights are adjusted to reduce this measure of error. For regression, this error can be sum-of-squared errors. For classification, this error can be either squared error or cross-entropy (deviation). See, e.g., Hastie et al., 2001, *The Elements of Statistical Learning*, Springer-Verlag, New York.

Three commonly used training protocols are stochastic, batch, and on-line. In stochastic training, patterns are chosen randomly from the training set and the network weights are updated for each pattern presentation. Multilayer nonlinear networks trained by gradient descent methods such as stochastic back-propagation perform a maximum-likelihood estimation of the weight values in the model defined by the network topology. In batch training, all patterns are presented to the network before learning takes place. Typically, in batch training, several passes are made through the training data. In online training, each pattern is presented once and only once to the net.

In some embodiments, consideration is given to starting values for weights. If the weights are near zero, then the operative part of the sigmoid commonly used in the hidden layer of a neural network (see, e.g., Hastie et al., 2001, *The Elements of Statistical Learning*, Springer-Verlag, New York) is roughly linear, and hence the neural network collapses into an approximately linear model. In some embodiments, starting values for weights are chosen to be random values near zero. Hence the model starts out nearly linear, and becomes nonlinear as the weights increase. Individual units localize to directions and introduce nonlinearities where needed. Use of exact zero weights leads to zero derivatives and perfect symmetry, and the algorithm never moves. Alternatively, starting with large weights often leads to poor solutions.

Since the scaling of inputs determines the effective scaling of weights in the bottom layer, it can have a large effect on the quality of the final solution. Thus, in some embodiments, at the outset all expression values are standardized to have mean zero and a standard deviation of one. This ensures all inputs are treated equally in the regularization process, and allows one to choose a meaningful range for the random starting weights. With standardization inputs, it is typical to take random uniform weights over the range [−0.7, +0.7].

A recurrent problem in the use of networks having a hidden layer is the optimal number of hidden units to use in the network. The number of inputs and outputs of a network are determined by the problem to be solved. In the present invention, the number of inputs for a given neural network can be the number of molecular markers in the selected set of molecular markers of the invention. The number of output for the neural network will typically be just one. However, in some embodiment more than one output is used so that more than just two states can be defined by the network. If too many hidden units are used in a neural network, the network will have too many degrees of freedom and is trained too long, there is a danger that the network will overfit the data. If there are too few hidden units, the training set cannot be learned. Generally speaking, however, it is better to have too many hidden units than too few. With too few hidden units, the model might not have enough flexibility to capture the nonlinearities in the data; with too many hidden units, the extra weight can be shrunk towards zero if appropriate regularization or pruning, as described below, is used. In typical embodiments, the number of hidden units is somewhere in the range of 5 to 100, with the number increasing with the number of inputs and number of training cases.

One general approach to determining the number of hidden units to use is to apply a regularization approach. In the regularization approach, a new criterion function is constructed that depends not only on the classical training error, but also on classifier complexity. Specifically, the new criterion function penalizes highly complex models; searching for the minimum in this criterion is to balance error on the training set with error on the training set plus a regularization term, which expresses constraints or desirable properties of solutions:

$$J=J_{pat}+\lambda J_{reg}.$$

The parameter $\lambda$ is adjusted to impose the regularization more or less strongly. In other words, larger values for $\lambda$ will tend to shrink weights towards zero: typically cross-validation with a validation set is used to estimate $\lambda$. This validation set can be obtained by setting aside a random subset of the training population. Other forms of penalty can also be used, for example the weight elimination penalty (see, e.g., Hastie et al., 2001, *The Elements of Statistical Learning*, Springer-Verlag, New York).

Another approach to determine the number of hidden units to use is to eliminate—prune—weights that are least needed. In one approach, the weights with the smallest magnitude are eliminated (set to zero). Such magnitude-based pruning can work, but is nonoptimal; sometimes weights with small magnitudes are important for learning and training data. In some embodiments, rather than using a magnitude-based pruning approach, Wald statistics are computed. The fundamental idea in Wald Statistics is that they can be used to estimate the importance of a hidden unit (weight) in a model. Then, hidden units having the least importance are eliminated (by setting their input and output weights to zero). Two algorithms in this regard are the Optimal Brain Damage (OBD) and the Optimal Brain Surgeon (OBS) algorithms that use second-order approximation to predict how the training error depends upon a weight, and eliminate the weight that leads to the smallest increase in training error.

Optimal Brain Damage and Optimal Brain Surgeon share the same basic approach of training a network to local minimum error at weight w, and then pruning a weight that leads to the smallest increase in the training error. The predicted functional increase in the error for a change in full weight vector δw is:

$$\delta J = \left(\frac{\partial J}{\partial w}\right)^t \cdot \delta w + \frac{1}{2}\delta w^t \cdot \frac{\partial^2 J}{\partial w^2} \cdot \delta w + O(\|\delta w\|^3)$$

where $$\frac{\partial^2 J}{\partial w^2}$$

is the Hessian matrix. The first term vanishes because we are at a local minimum in error; third and higher order terms are ignored. The general solution for minimizing this function given the constraint of deleting one weight is:

$$\delta w = -\frac{w_q}{[H^{-1}]_{qq}} H^{-1} \cdot u_q \text{ and } L_q = \frac{1}{2}\frac{w_q^2}{[H^{-1}]_{qq}}$$

Here, $u_q$ is the unit vector along the qth direction in weight space and $L_q$ is approximation to the saliency of the weight q—the increase in training error if weight q is pruned and the other weights updated δw. These equations require the inverse of H. One method to calculate this inverse matrix is to start with a small value, $H_0^{-1} = \alpha_{-1} I$, where α is a small parameter—effectively a weight constant. Next the matrix is updated with each pattern according to $$H_{m+1}^{-1} = H_m^{-1} - \frac{H_m^{-1} X_{m+1} X_{m+1}^T H_m^{-1}}{\frac{n}{a_m} + X_{m+1}^T H_m^{-1} X_{m+1}}$$

where the subscripts correspond to the pattern being presented and $\alpha_m$ decreases with m. After the full training set has been presented, the inverse Hessian matrix is given by $H^- = H_n^{-1}$. In algorithmic form, the Optimal Brain Surgeon method is:
  begin initialize $n_H$, w, θ
    train a reasonably large network to minimum error
    do compute $H^{-1}$ by Eqn. 1

$$q^* \leftarrow \arg\min_q w_q^2/(2[H^{-1}]_{qq})(\text{saliency } L_q)$$

$$w \leftarrow w - \frac{w_{q^*}}{[H^{-1}]_{q^*q^*}} H^{-1} e_{q^*} \text{ (saliency } L_q)$$

until J(w)>θ
    return w
  end
The Optimal Brain Damage method is computationally simpler because the calculation of the inverse Hessian matrix in line 3 is particularly simple for a diagonal matrix. The above algorithm terminates when the error is greater than a criterion initialized to be θ. Another approach is to change line 6 to terminate when the change in J(w) due to elimination of a weight is greater than some criterion value.

In some embodiments, a back-propagation neural network (see, for example Abdi, 1994, "A neural network primer", J. Biol System. 2, 247-283) containing a single hidden layer of ten neurons (ten hidden units) found in EasyNN-Plus version 4.0 g software package (Neural Planner Software Inc.) is used. In a specific example, parameter values within the EasyNN-Plus program are set as follows: a learning rate of 0.05, and a momentum of 0.2. In some embodiments in which the EasyNN-Plus version 4.0 g software package is used, "outlier" samples are identified by performing twenty independently-seeded trials involving 20,000 learning cycles each.

5.2.1.3. Support Vector Machine

In some embodiments of the present invention, support vector machines (SVMs) are used to classify subjects using expression profiles of marker genes described in the present invention. The SVM takes the patient marker profile as an input and generates an output comprising the progression status and/or IM responsiveness. General description of SVM can be found in, for example, Cristianini and Shawe-Taylor, 2000, *An Introduction to Support Vector Machines*, Cambridge University Press, Cambridge, Boser et al., 1992, "A training algorithm for optimal margin classifiers, in *Proceedings of the 5th Annual ACM Workshop on Computational Learning Theory*, ACM Press, Pittsburgh, Pa., pp. 142-152; Vapnik, 1998, *Statistical Learning Theory*, Wiley, N.Y.; Duda, *Pattern Classification*, Second Edition, 2001, John Wiley & Sons, Inc.; Hastie, 2001, *The Elements of Statistical Learning*, Springer, N.Y.; and Furey et al., 2000, Bioinformatics 16, 906-914. Applications of SVM in biological applications are described in Jaakkola et al., *Proceedings of the 7th International Conference on Intelligent Systems for Molecular Biology*, AAAI Press, Menlo Park, Calif. (1999); Brown et al., *Proc. Natl. Acad. Sci.* 97(1):262-67 (2000); Zien et al., *Bioinformatics*, 16(9):799-807 (2000); Furey et al., *Bioinformatics*, 16(10):906-914 (2000)

In one approach, when a SVM is used, the gene expression data is standardized to have mean zero and unit variance and the members of a training population are randomly divided into a training set and a test set. For example, in one embodiment, two thirds of the members of the training population are placed in the training set and one third of the members of the training population are placed in the test set. The expression values for a selected set of genes of the present invention is used to train the SVM. Then the ability for the trained SVM to correctly classify members in the test set is determined. In some embodiments, this computation is performed several times for a given selected set of molecular markers. In each iteration of the computation, the members of the training population are randomly assigned to the training set and the test set. Then, the quality of the combination of molecular markers is taken as the average of each such iteration of the SVM computation.

Support vector machines map a given set of binary labeled training data to a high-dimensional feature space and separate the two classes of data with a maximum margin hyperplane. In general, this hyperplane corresponds to a nonlinear decision boundary in the input space. Let $X \in R_0 \subset \Re^n$ be the input vectors, $y \in \{-1,+1\}$ be the labels, and $\phi: R_0 \to F$ be the mapping from input space to feature space. Then the SVM learning algorithm finds a hyperplane (w,b) such that the quantity $$\gamma = \min_i y_i \{\langle w, \phi(X_i)\rangle - b\}$$

is maximized, where the vector w has the same dimensionality as F, b is a real number, and γ is called the margin. The corresponding decision function is then $$f(X) = \text{sign}(\langle w, \phi(X) \rangle - b)$$

This minimum occurs when $$w = \sum_i \alpha_i y_i \phi(X_i)$$

where $\{\alpha_i\}$ are positive real numbers that maximize $$\sum_i \alpha_i - \sum_{ij} \alpha_i \alpha_j y_i y_j \langle \phi(X_i), \phi(X_j) \rangle$$

subject to $$\sum_i \alpha_i y_i = 0, \alpha_i > 0$$

The decision function can equivalently be expressed as $$f(X) = \text{sign}\left(\sum_i \alpha_i y_i \langle \phi(X_i), \phi(X) \rangle - b\right)$$

From this equation it can be seen that the $\alpha_i$ associated with the training point $X_i$ expresses the strength with which that point is embedded in the final decision function. A remarkable property of this alternative representation is that only a subset of the points will be associated with a non-zero $\alpha_i$. These points are called support vectors and are the points that lie closest to the separating hyperplane. The sparseness of the α vector has several computational and learning theoretic consequences. It is important to note that neither the learning algorithm nor the decision function needs to represent explicitly the image of points in the feature space, $\phi(X_i)$, since both use only the dot products between such images, $\langle \phi(X_i), \phi(X_j) \rangle$. Hence, if one were given a function $K(X, Y) = \langle \phi(X), \phi(X) \rangle$, one could learn and use the maximum margin hyperplane in the feature space without ever explicitly performing the mapping. For each continuous positive definite function $K(X, Y)$ there exists a mapping $\phi$ such that $K(X, Y) = \langle \phi(X), \phi(X) \rangle$ for all $X, Y \in R_o$ (Mercer's Theorem). The function $K(X, Y)$ is called the kernel function. The use of a kernel function allows the support vector machine to operate efficiently in a nonlinear high-dimensional feature spaces without being adversely affected by the dimensionality of that space. Indeed, it is possible to work with feature spaces of infinite dimension. Moreover, Mercer's theorem makes it possible to learn in the feature space without even knowing φ and F. The matrix $K_{ij} = \langle \phi(X_i), \phi(X_j) \rangle$ is called the kernel matrix. Finally, note that the learning algorithm is a quadratic optimization problem that has only a global optimum. The absence of local minima is a significant difference from standard pattern recognition techniques such as neural networks. For moderate sample sizes, the optimization problem can be solved with simple gradient descent techniques. In the presence of noise, the standard maximum margin algorithm described above can be subject to overfitting, and more sophisticated techniques should be used. This problem arises because the maximum margin algorithm always finds a perfectly consistent hypothesis and does not tolerate training error. Sometimes, however, it is necessary to trade some training accuracy for better predictive power. The need for tolerating training error has led to the development the soft-margin and the margin-distribution classifiers. One of these techniques replaces the kernel matrix in the training phase as follows:

$$K \leftarrow K + \lambda I$$

while still using the standard kernel function in the decision phase. By tuning λ, one can control the training error, and it is possible to prove that the risk of misclassifying unseen points can be decreased with a suitable choice of λ.

If instead of controlling the overall training error one wants to control the trade-off between false positives and false negatives, it is possible to modify K as follows:

$$K \leftarrow K + \lambda D$$

where D is a diagonal matrix whose entries are either $d^+$ or $d^-$, in locations corresponding to positive and negative examples. It is possible to prove that this technique is equivalent to controlling the size of the $\alpha_i$ in a way that depends on the size of the class, introducing a bias for larger $\alpha_i$ in the class with smaller d. This in turn corresponds to an asymmetric margin; i.e., the class with smaller d will be kept further away from the decision boundary. In some cases, the extreme imbalance of the two classes, along with the presence of noise, creates a situation in which points from the minority class can be easily mistaken for mislabeled points. Enforcing a strong bias against training errors in the minority class provides protection against such errors and forces the SVM to make the positive examples support vectors. Thus, choosing $$d^+ = \frac{1}{n^+} \text{ and } d^- = \frac{1}{n^-}$$

provides a heuristic way to automatically adjust the relative importance of the two classes, based on their respective cardinalities. This technique effectively controls the trade-off between sensitivity and specificity.

In the present invention, a linear kernel can be used. The similarity between two marker profiles X and Y can be the dot product X·Y. In one embodiment, the kernel is $$K(X, Y) = X \cdot Y + 1$$

In another embodiment, a kernel of degree d is used $K(X, Y) = (X \cdot Y + 1)^d$, where d can be either 2, 3, . . . .
In still another embodiment, a Gaussian kernel is used $$K(X, Y) = \exp\left(\frac{-|X-Y|^2}{2\sigma^2}\right)$$

where σ is the width of the Gaussian.

5.2.1.4. Logistic Regression

In some embodiments, the progression classifier is based on a regression model, preferably a logistic regression model. Such a regression model includes a coefficient for each of the molecular markers in a selected set of molecular markers of the invention. In such embodiments, the coefficients for the regression model are computed using, for example, a maximum likelihood approach. In particular embodiments, molecular marker data from two different clinical groups, e.g., chronic phase and advanced phase or imatinib resistant and imatinib sensitive, is used and the dependent variable is the clinical status of the patient for which molecular marker characteristic data are from.

Some embodiments of the present invention provide generalizations of the logistic regression model that handle multicategory (polychotomous) responses. Such embodiments can be used to discriminate an organism into one or three or more clinical groups, e.g., chronic phase, accelerated phase, and blast phase. Such regression models use multicategory logit models that simultaneously refer to all pairs of categories, and describe the odds of response in one category instead of another. Once the model specifies logits for a certain (J−1) pairs of categories, the rest are redundant. See, for example, Agresti, *An Introduction to Categorical Data Analysis*, John Wiley & Sons, Inc., 1996, New York, Chapter 8, which is hereby incorporated by reference.

5.2.1.5. Discriminant Analysis

Linear discriminant analysis (LDA) attempts to classify a subject into one of two categories based on certain object properties. In other words, LDA tests whether object attributes measured in an experiment predict categorization of the objects. LDA typically requires continuous independent variables and a dichotomous categorical dependent variable. In the present invention, the expression values for the selected set of molecular markers of the invention across a subset of the training population serve as the requisite continuous independent variables. The clinical group classification of each of the members of the training population serves as the dichotomous categorical dependent variable.

LDA seeks the linear combination of variables that maximizes the ratio of between-group variance and within-group variance by using the grouping information. Implicitly, the linear weights used by LDA depend on how the expression of a molecular marker across the training set separates in the two groups (e.g., a group that has CP-CML and a group that have ADV-CMP) and how this gene expression correlates with the expression of other genes. In some embodiments, LDA is applied to the data matrix of the N members in the training sample by K genes in a combination of genes described in the present invention. Then, the linear discriminant of each member of the training population is plotted. Ideally, those members of the training population representing a first subgroup (e.g. those subjects that have CP-CML) will cluster into one range of linear discriminant values (e.g., negative) and those member of the training population representing a second subgroup (e.g. those subjects that have ADV-CML) will cluster into a second range of linear discriminant values (e.g., positive). The LDA is considered more successful when the separation between the clusters of discriminant values is larger. For more information on linear discriminant analysis, see Duda, *Pattern Classification*, Second Edition, 2001, John Wiley & Sons, Inc; and Hastie, 2001, *The Elements of Statistical Learning*, Springer, N.Y.; Venables & Ripley, 1997, *Modern Applied Statistics with s-plus*, Springer, N.Y.

Quadratic discriminant analysis (QDA) takes the same input parameters and returns the same results as LDA. QDA uses quadratic equations, rather than linear equations, to produce results. LDA and QDA are interchangeable, and which to use is a matter of preference and/or availability of software to support the analysis. Logistic regression takes the same input parameters and returns the same results as LDA and QDA.

5.2.1.6. Decision Trees

In some embodiments of the present invention, decision trees are used to classify patients using expression data for a selected set of molecular markers of the invention. Decision tree algorithms belong to the class of supervised learning algorithms. The aim of a decision tree is to induce a classifier (a tree) from real-world example data. This tree can be used to classify unseen examples which have not been used to derive the decision tree.

A decision tree is derived from training data. An example contains values for the different attributes and what class the example belongs. In one embodiment, the training data is expression data for a combination of genes described in the present invention across the training population.

The following algorithm describes a decision tree derivation:

Tree(Examples,Class,Attributes)
  Create a root node
  If all Examples have the same Class value, give the root this label
  Else if Attributes is empty label the root according to the most common value
  Else begin
  Calculate the information gain for each attribute
  Select the attribute A with highest information gain and make this the root attribute
  For each possible value, v, of this attribute
    Add a new branch below the root, corresponding to A=v
    Let Examples(v) be those examples with A=v
    If Examples(v) is empty, make the new branch a leaf node labeled with the most common value among Examples
    Else let the new branch be the tree created by
      Tree(Examples(v),Class,Attributes—{A}) end A more detailed description of the calculation of information gain is shown in the following. If the possible classes $v_i$ of the examples have probabilities $P(v_i)$ then the information content I of the actual answer is given by:

$$I(P(v_1), \ldots, P(v_n)) = \sum_{i=1}^{n} -P(v_i)\log_2 P(v_i)$$

The I-value shows how much information we need in order to be able to describe the outcome of a classification for the specific dataset used. Supposing that the dataset contains p positive (e.g. has ADV-CML) and n negative (e.g. has CP-CML) examples (e.g. individuals), the information contained in a correct answer is:

$$I\left(\frac{p}{p+n}, \frac{n}{p+n}\right) = -\frac{p}{p+n}\log_2\frac{p}{p+n} - \frac{n}{p+n}\log_2\frac{n}{p+n}$$

where $\log_2$ is the logarithm using base two. By testing single attributes the amount of information needed to make a correct classification can be reduced. The remainder for a specific attribute A (e.g. a gene) shows how much the information that is needed can be reduced.

$$\text{Remainder}(A) = \sum_{i=1}^{v} \frac{p_i + n_i}{p+n} I\left(\frac{p_i}{p_i+n_i}, \frac{n_i}{p_i+n_i}\right)$$

"v" is the number of unique attribute values for attribute A in a certain dataset, "i" is a certain attribute value, "$p_i$" is the number of examples for attribute A where the classification is positive (e.g. cancer), "$n_i$" is the number of examples for attribute A where the classification is negative (e.g. healthy).

The information gain of a specific attribute A is calculated as the difference between the information content for the classes and the remainder of attribute A:

$$\text{Gain }(A) = I\left(\frac{p}{p+n}, \frac{n}{p+n}\right) - \text{Remainder }(A)$$

The information gain is used to evaluate how important the different attributes are for the classification (how well they split up the examples), and the attribute with the highest information.

In general there are a number of different decision tree algorithms, many of which are described in Duda, *Pattern Classification, Second Edition*, 2001, John Wiley & Sons, Inc. Decision tree algorithms often require consideration of feature processing, impurity measure, stopping criterion, and pruning. Specific decision tree algorithms include, cut are not limited to classification and regression trees (CART), multivariate decision trees, ID3, and C4.5.

In one approach, when an exemplary embodiment of a decision tree is used, the gene expression data for a selected set of molecular markers of the invention across a training population is standardized to have mean zero and unit variance. The members of the training population are randomly divided into a training set and a test set. For example, in one embodiment, two thirds of the members of the training population are placed in the training set and one third of the members of the training population are placed in the test set. The expression values for a select combination of genes described in the present invention is used to construct the decision tree. Then, the ability for the decision tree to correctly classify members in the test set is determined. In some embodiments, this computation is performed several times for a given combination of molecular markers. In each iteration of the computation, the members of the training population are randomly assigned to the training set and the test set. Then, the quality of the combination of molecular markers is taken as the average of each such iteration of the decision tree computation.

5.2.1.7. Clustering

In some embodiments, the expression values for a selected set of molecular markers of the invention are used to cluster a training set. For example, consider the case in which ten genes described in the present invention are used. Each member m of the training population will have expression values for each of the ten genes. Such values from a member m in the training population define the vector:

| $X_{1m}$ | $X_{2m}$ | $X_{3m}$ | $X_{4m}$ | $X_{5m}$ | $X_{6m}$ | $X_{7m}$ | $X_{8m}$ | $X_{9m}$ | $X_{10m}$ | where $X_{im}$ is the expression level of the $i^{th}$ gene in organism m. If there are m organisms in the training set, selection of i genes will define m vectors. Note that the methods of the present invention do not require that each the expression value of every single gene used in the vectors be represented in every single vector m. In other words, data from a subject in which one of the $i^{th}$ genes is not found can still be used for clustering. In such instances, the missing expression value is assigned either a "zero" or some other normalized value. In some embodiments, prior to clustering, the gene expression values are normalized to have a mean value of zero and unit variance.

Those members of the training population that exhibit similar expression patterns across the training group will tend to cluster together. A particular combination of genes of the present invention is considered to be a good classifier in this aspect of the invention when the vectors cluster into the trait groups found in the training population. For instance, if the training population includes patients with chronic phase and advanced phase CML, a clustering classifier will cluster the population into two groups, with each group uniquely representing either chronic phase or advanced phase.

Clustering is described on pages 211-256 of Duda and Hart, *Pattern Classification and Scene Analysis*, 1973, John Wiley & Sons, Inc., New York. As described in Section 6.7 of Duda, the clustering problem is described as one of finding natural groupings in a dataset. To identify natural groupings, two issues are addressed. First, a way to measure similarity (or dissimilarity) between two samples is determined. This metric (similarity measure) is used to ensure that the samples in one cluster are more like one another than they are to samples in other clusters. Second, a mechanism for partitioning the data into clusters using the similarity measure is determined.

Similarity measures are discussed in Section 6.7 of Duda, where it is stated that one way to begin a clustering investigation is to define a distance function and to compute the matrix of distances between all pairs of samples in a dataset. If distance is a good measure of similarity, then the distance between samples in the same cluster will be significantly less than the distance between samples in different clusters. However, as stated on page 215 of Duda, clustering does not require the use of a distance metric. For example, a nonmetric similarity ftmction s(x, x') can be used to compare two vectors x and x'. Conventionally, s(x, x') is a symmetric function whose value is large when x and x' are somehow "similar". An example of a nonmetric similarity function s(x, x') is provided on page 216 of Duda.

Once a method for measuring "similarity" or "dissimilarity" between points in a dataset has been selected, clustering requires a criterion function that measures the clustering quality of any partition of the data. Partitions of the data set that extremize the criterion function are used to cluster the data. See page 217 of Duda. Criterion functions are discussed in Section 6.8 of Duda.

More recently, Duda et al., Pattern Classification, $2^{nd}$ edition, John Wiley & Sons, Inc. New York, has been published. Pages 537-563 describe clustering in detail. More information on clustering techniques can be found in Kaufman and Rousseeuw, 1990, *Finding Groups in Data: An Introduction to Cluster Analysis*, Wiley, New York, N.Y.; Everitt, 1993, *Cluster analysis* (3d ed.), Wiley, New York, N.Y.; and Backer, 1995, *Computer-Assisted Reasoning in Cluster Analysis*, Prentice Hall, Upper Saddle River, N.J. Particular exemplary clustering techniques that can be used in the present invention include, but are not limited to, hierarchical clustering (agglomerative clustering using nearest-neighbor algorithm, farthest-neighbor algorithm, the average linkage algorithm, the centroid algorithm, or the sum-of-squares algorithm), k-means clustering, fuzzy k-means clustering algorithm, and Jarvis-Patrick clustering.

5.2.1.8. Principal Component Analysis

Principal component analysis (PCA) has been proposed to analyze gene expression data. Principal component analysis is a classical technique to reduce the dimensionality of a data set by transforming the data to a new set of variable (principal components) that summarize the features of the data. See, for example, Jolliffe, 1986, *Principal Component Analysis*, Springer, N.Y. Principal components (PCs) are uncorrelate and are ordered such that the $k^{th}$ PC has the kth largest variance among PCs. The $k^{th}$ PC can be interpreted as the direction that maximizes the variation of the projections of the data points such that it is orthogonal to the first k−1 PCs. The first few PCs capture most of the variation in the data set. In contrast, the last few PCs are often assumed to capture only the residual 'noise' in the data.

PCA can also be used to create a progression classifier in accordance with the present invention. In such an approach, vectors for a selected set of molecular markers of the invention can be constructed in the same manner described for clustering above. In fact, the set of vectors, where each vector represents the expression values for the select genes from a particular member of the training population, can be considered a matrix. In some embodiments, this matrix is represented in a Free-Wilson method of qualitative binary description of monomers (Kubinyi, 1990, 3*D QSAR in drug design theory methods and applications*, Pergamon Press, Oxford, pp 589-638), and distributed in a maximally compressed space using PCA so that the first principal component (PC) captures the largest amount of variance information possible, the second principal component (PC) captures the second largest amount of all variance information, and so forth until all variance information in the matrix has been accounted for.

Then, each of the vectors (where each vector represents a member of the training population) is plotted. Many different types of plots are possible. In some embodiments, a one-dimensional plot is made. In this one-dimensional plot, the value for the first principal component from each of the members of the training population is plotted. In this form of plot, the expectation is that members of a first group (e.g. chronic phase patients) will cluster in one range of first principal component values and members of a second group (e.g., advance phase patients) will cluster in a second range of first principal component values.

In one example, the training population comprises two groups: chronic phase patients and advanced phase patients or imatinib resistant and imatinib sensitive. The first principal component is computed using the molecular marker expression values for the select genes of the present invention across the entire training population data set. Then, each member of the training set is plotted as a function of the value for the first principal component. In this example, those members of the training population in which the first principal component is positive are the chronic phase (or imatinib sensitive) patients and those members of the training population in which the first principal component is negative are advanced phase (or imatinib resistant) patients.

In some embodiments, the members of the training population are plotted against more than one principal component. For example, in some embodiments, the members of the training population are plotted on a two-dimensional plot in which the first dimension is the first principal component and the second dimension is the second principal component. In such a two-dimensional plot, the expectation is that members of each subgroup represented in the training population will cluster into discrete groups. For example, a first cluster of members in the two-dimensional plot will represent subjects with CP-CML, a second cluster of members in the two-dimensional plot will represent subjects with ADV-CML, and so forth.

In some embodiments, the members of the training population are plotted against more than two principal components and a determination is made as to whether the members of the training population are clustering into groups that each uniquely represents a subgroup found in the training population. In some embodiments, principal component analysis is performed by using the R mva package (Anderson, 1973, *Cluster Analysis for applications*, Academic Press, New York 1973; Gordon, *Classification*, Second Edition, Chapman and Hall, CRC, 1999.). Principal component analysis is further described in Duda, *Pattern Classification*, Second Edition, 2001, John Wiley & Sons, Inc.

5.2.1.9. Nearest Neighbor Classifier Analysis

Nearest neighbor classifiers are memory-based and require no model to be fit. Given a query point $x_0$, the k training points $x_{(r)}$, r, . . . , k closest in distance to $x_0$ are identified and then the point $x_0$ is classified using the k nearest neighbors. Ties can be broken at random. In some embodiments, Euclidean distance in feature space is used to determine distance as:

$$d_{(i)}=\|x_{(i)}-x_0\|.$$

Typically, when the nearest neighbor algorithm is used, the expression data used to compute the linear discriminant is standardized to have mean zero and variance 1. In the present invention, the members of the training population are randomly divided into a training set and a test set. For example, in one embodiment, two thirds of the members of the training population are placed in the training set and one third of the members of the training population are placed in the test set. Profiles of a selected set of molecular markers of the invention represents the feature space into which members of the test set are plotted. Next, the ability of the training set to correctly characterize the members of the test set is computed. In some embodiments, nearest neighbor computation is performed several times for a given combination of genes of the present invention. In each iteration of the computation, the members of the training population are randomly assigned to the training set and the test set. Then, the quality of the combination of genes is taken as the average of each such iteration of the nearest neighbor computation.

The nearest neighbor rule can be refined to deal with issues of unequal class priors, differential misclassification costs, and feature selection. Many of these refinements involve some form of weighted voting for the neighbors. For more information on nearest neighbor analysis, see Duda, *Pattern Classification*, Second Edition, 2001, John Wiley & Sons, Inc; and Hastie, 2001, *The Elements of Statistical Learning*, Springer, N.Y.

5.2.1.10. Evolutionary Methods

Inspired by the process of biological evolution, evolutionary methods of classifier design employ a stochastic search for an optimal classifier. In broad overview, such methods create several classifiers—a population—from measurements of gene products of the present invention. Each classifier varies somewhat from the other. Next, the classifiers are scored on expression data across the training population. In keeping with the analogy with biological evolution, the resulting (scalar) score is sometimes called the fitness. The classifiers are ranked according to their score and the best classifiers are retained (some portion of the total population of classifiers). Again, in keeping with biological terminology, this is called survival of the fittest. The classifiers are stochastically altered in the next generation—the children or offspring. Some offspring classifiers will have higher scores than their parent in the previous generation, some will have lower scores. The overall process is then repeated for the subsequent generation: The classifiers are scored and the best ones are retained, randomly altered to give yet another generation, and so on. In part, because of the ranking, each generation has, on average, a slightly higher score than the previous one. The process is halted when the single best classifier in a generation has a score that exceeds a desired criterion value. More information on evolutionary methods is found in, for example, Duda, *Pattern Classification*, Second Edition, 2001, John Wiley & Sons, Inc.

5.2.1.11. Bagging, Boosting and the Random Subspace Method

Bagging, boosting and the random subspace method are combining techniques that can be used to improve weak classifiers. These techniques are designed for, and usually applied to, decision trees. In addition, Skurichina and Duin provide evidence to suggest that such techniques can also be useful in linear discriminant analysis.

In bagging, one samples the training set, generating random independent bootstrap replicates, constructs the classifier on each of these, and aggregates them by a simple majority vote in the final decision rule. See, for example, Breiman, 1996, Machine Learning 24, 123-140; and Efron & Tibshirani, *An Introduction to Bootstrap*, Chapman & Hall, New York, 1993.

In boosting, classifiers are constructed on weighted versions of the training set, which are dependent on previous classification results. Initially, all objects have equal weights, and the first classifier is constructed on this data set. Then, weights are changed according to the performance of the classifier. Erroneously classified objects (molecular markers in the data set) get larger weights, and the next classifier is boosted on the reweighted training set. In this way, a sequence of training sets and classifiers is obtained, which is then combined by simple majority voting or by weighted majority voting in the final decision. See, for example, Freund & Schapire, "Experiments with a new boosting algorithm," Proceedings 13$^{th}$ International Conference on Machine Learning, 1996, 148-156.

To illustrate boosting, consider the case where there are two phenotypic groups exhibited by the population under study, phenotype 1 (e.g., advanced phase patients), and phenotype 2 (e.g., chronic phase patients). Given a vector of molecular markers X, a classifier G(X) produces a prediction taking one of the type values in the two value set: {phenotype 1, phenotype 2}. The error rate on the training sample is $$\overline{err} = \frac{1}{N}\sum_{i=1}^{N} I(y_i \neq G(x_i))$$

where N is the number of subjects in the training set (the sum total of the subjects that have either phenotype 1 or phenotype 2).

A weak classifier is one whose error rate is only slightly better than random guessing. In the boosting algorithm, the weak classification algorithm is repeatedly applied to modified versions of the data, thereby producing a sequence of weak classifiers $G_m(x)$, m=1, 2, ..., M. The predictions from all of the classifiers in this sequence are then combined through a weighted majority vote to produce the final prediction:

$$G(x) = \text{sign}\left(\sum_{m=1}^{M} \alpha_m G_m(x)\right)$$

Here $\alpha_1, \alpha_2, \ldots, \alpha_M$ are computed by the boosting algorithm and their purpose is to weigh the contribution of each respective $G_m(x)$. Their effect is to give higher influence to the more accurate classifiers in the sequence.

The data modifications at each boosting step consist of applying weights $w_1, w_2, \ldots, w_n$ to each of the training observations $(x_i, y_i)$, i=1, 2, ..., N. Initially all the weights are set to $w_i=1/N$, so that the first step simply trains the classifier on the data in the usual manner. For each successive iteration m=2, 3, ..., M the observation weights are individually modified and the classification algorithm is reapplied to the weighted observations. At stem m, those observations that were misclassified by the classifier $G_{m-1}(x)$ induced at the previous step have their weights increased, whereas the weights are decreased for those that were classified correctly. Thus as iterations proceed, observations that are difficult to correctly classify receive ever-increasing influence. Each successive classifier is thereby forced to concentrate on those training observations that are missed by previous ones in the sequence.

The exemplary boosting algorithm is summarized as follows:

1. Initialize the observation weights $w_i=1/N$, i=1, 2, ..., N.
2. For m=1 to M:
  (a) Fit a classifier $G_m(x)$ to the training set using weights $w_i$.
  (b) Compute $$err_m = \frac{\sum_{i=1}^{N} w_i I(y_i \neq G_m(x_i))}{\sum_{i=1}^{N} w_i}$$

(c) Compute $\alpha_m = \log((1-err_m)/err_m)$.
  (d) Set $w_i \leftarrow w_i \cdot \exp[\alpha_m \cdot I(y_i \neq G_m(x_i))]$, i=1, 2, ..., N.

3. Output $G(x) = \text{sign}\left[\sum_{m=1}^{M} \alpha_m G_m(x)\right]$

In the algorithm, the current classifier $G_m(x)$ is induced on the weighted observations at line 2a. The resulting weighted error rate is computed at line 2b. Line 2c calculates the weight $\alpha_m$ given to $G_m(x)$ in producing the final classifier G(x) (line 3). The individual weights of each of the observations are updated for the next iteration at line 2d. Observations misclassified by $G_m(x)$ have their weights scaled by a factor $\exp(\alpha_m)$, increasing their relative influence for inducing the next classifier $G_{m+1}(x)$ in the sequence. In some embodiments, modifications of the Freund and Schapire, 1997, Journal of Computer and System Sciences 55, pp. 119-139, boosting method are used. See, for example, Hasti et al., *The Elements of Statistical Learning*, 2001, Springer, N.Y., Chapter 10. In some embodiments, boosting or adaptive boosting methods are used.

In some embodiments, modifications of Freund and Schapire, 1997, Journal of Computer and System Sciences 55, pp. 119-139, are used. For example, in some embodiments, feature preselection is performed using a technique such as the nonparametric scoring methods of Park et al., 2002, Pac. Symp. Biocomput. 6, 52-63. Feature preselection is a form of dimensionality reduction in which the genes that discriminate between classifications the best are selected for use in the classifier. Then, the LogitBoost procedure introduced by Friedman et al., 2000, Ann Stat 28, 337-407 is used rather than the boosting procedure of Freund and Schapire. In some embodiments, the boosting and other classification methods of Ben-Dor et al., 2000, Journal of Computational Biology 7, 559-583 are used in the present invention. In some embodiments, the boosting and other classification methods of Freund and Schapire, 1997, Journal of Computer and System Sciences 55, 119-139, are used.

In the random subspace method, classifiers are constructed in random subspaces of the data feature space. These classifiers are usually combined by simple majority voting in the final decision rule. See, for example, Ho, "The Random subspace method for constructing decision forests," IEEE Trans Pattern Analysis and Machine Intelligence, 1998; 20(8): 832-844.

5.2.1.12. Other Algorithms

The pattern classification and statistical techniques described above are merely examples of the types of models that can be used to construct a model for classification. Moreover, combinations of the techniques described above can be used. Some combinations, such as the use of the combination of decision trees and boosting, have been described. However, many other combinations are possible. In addition, in other techniques in the art such as Projection Pursuit and Weighted Voting can be used to construct a progression classifier.

5.2.2. Methods of Determining Aberrant Regulation of CML Target Genes

The invention also provides methods and compositions for determining aberrant regulation in CML target genes and/or their encoded proteins. Such information can be used to determine a treatment regimen for a patient. For example, patients who have a defective regulation of a CML target gene can be identified. A treatment regimen including a therapy to regulate the gene can be prescribed to the patient. Thus, the invention provides methods and composition for assigning treatment regimen for a cancer patient. The invention also provides methods and composition for monitoring treatment progress for a CML patient based on the status of one or more of the CML target proteins.

A variety of methods can be employed for the diagnostic and prognostic evaluation of patients for their status of CML target genes or proteins. In one embodiment, measurements of expression level of one or more of the CML target genes listed in Tables 5a and 5b, and/or abundance or activity level the encoded proteins are used. One or more of these genes or proteins having a level of expression or activity deviated from a respective predetermined threshold indicate aberrant regulation of the genes or proteins.

In one embodiment, the method comprises determining an expression level of a CML target gene (a gene listed in Table 5a or 5b) in the sample of a patient, and determining whether the expression level is deviated (above or below) a predetermined threshold, and the expression level deviated from a predetermined threshold level indicates aberrant regulation of the gene in the patient. Preferably, the predetermined threshold level is at least 2-fold, 4-fold, 8-fold, or 10-fold of the normal expression level of an aberrantly up-regulated CML target gene or less than 50%, 25%, 10% or 1% of the normal level of an aberrantly down-regulated CML target gene. In another embodiment, the method comprises determining a level of abundance of a CML target protein, i.e., a protein encoded by a CML target gene, in a sample from a patient, and determining whether the level of abundance is deviated a predetermined threshold, and a level of abundance of the protein deviated from a predetermined threshold level indicates aberrant regulation of the protein in the patient. In still another embodiment, the method comprises determining a level of activity of a protein encoded by the CML target gene in a sample of a patient, and determining whether the level of activity is deviated a predetermined threshold, and an activity level deviated from a predetermined threshold level indicates aberrant regulation of the protein in the patient. A reduced activity may be a result of mutation of the CML target gene. Thus, the invention also provides a method for evaluating the status of CML target in a patient, comprising determining a mutation in a CML target gene or a protein encoded by the CML target gene in a sample from the patient, and the detection of a mutation causing the activity of the CML target protein to deviate from a predetermined threshold level indicates aberrant regulation of the protein in the patient. Preferably, the predetermined threshold level of abundance or activity is at least 2-fold, 4-fold, 8-fold, or 10-fold above the normal level of abundance or activity of an aberrantly up-regulated CML target protein or less than 50%, 25%, 10% or 1% of the normal level of an aberrantly down-regulated CML target protein. In the foregoing embodiments, and the embodiments described below, the sample can be an ex vivo cell sample, e.g., cells in a cell culture, or in vivo cells.

In a specific embodiment, the method comprises determining an expression level of a CML target gene selected from the group consisting of the up-regulated genes listed in Table 3 (which is a subset of the genes listed in Table 5a) in the sample of a patient, and determining whether the expression level is above a predetermined threshold, and an expression level above a predetermined threshold level indicates aberrant regulation of the gene in the patient. Preferably, the predetermined threshold level is at least 2-fold, 4-fold, 8-fold, or 10-fold of the normal expression level of the gene. In another embodiment, the method comprises determining a level of abundance of a protein encoded by a gene selected from the group consisting of the up-regulated genes listed in Table 3 in a sample from a patient, and determining whether the level is above a predetermined threshold, and a level of abundance of the protein above a predetermined threshold level indicates aberrant regulation of the protein in the patient.

In another specific embodiment, the method comprises determining an expression level of a CML target gene selected from the group consisting of the down-regulated genes listed in Table 3 in the sample of a patient, and determining whether the expression level is below a predetermined threshold, and an expression level below a predetermined threshold level indicates aberrant regulation of the gene in the patient. Preferably, the predetermined threshold level is a level less than 50%, 25%, 10% or 1% of the normal expression level of the gene. In another embodiment, the method comprises determining a level of abundance of a protein encoded by a gene selected from the group consisting of the down-regulated genes listed in Table 3 in a sample from a patient, and determining whether the level is below a predetermined threshold, and a level of abundance of the protein below a predetermined threshold level indicates aberrant regulation of the protein in the patient.

In one embodiment, the method comprises determining an expression level of an imatinib resistance gene (a gene listed in Table 4) in the sample of a patient, and determining whether the expression level is deviated (above or below) a predetermined threshold, and an expression level deviated from a predetermined threshold level indicates that the patient is resistant to imatinib treatment. Preferably, the predetermined threshold level is at least 2-fold, 4-fold, 8-fold, or 10-fold of the normal expression level of an aberrantly up-regulated imatinib resistance gene or less than 50%, 25%, 10% or 1% of the normal level of an aberrantly down-regulated imatinib resistance gene. In another embodiment, the method comprises determining a level of abundance of an imatinib resistance protein, i.e., a protein encoded by an imatinib resistance gene, in a sample from a patient, and determining whether the level is deviated (above or below) a predetermined threshold, and a level of abundance of the protein deviated from a predetermined threshold level indicates that the patient is resistant to imatinib treatment. In still another embodiment, the method comprises determining a level of activity of a protein encoded by an imatinib resistance gene in a sample of a patient, and determining whether the level is deviated (above or below) a predetermined threshold, and an activity level deviated from a predetermined threshold level indicates that the patient is resistant to imatinib treatment. Such reduce activity may be a result of mutation of the imatinib resistance gene. Thus, the invention also provides a method for evaluating imatinib resistance in a patient, comprising determining a mutation in an imatinib resistance gene or a protein encoded by the imatinib resistance gene in a sample from the patient, and the detection of a mutation causing the activity of the imatinib resistance protein to deviate from a predetermined threshold level indicates the patient is resistant to imatinib treatment. Preferably, the predetermined threshold level of abundance or activity is at least 2-fold, 4-fold, 8-fold, or 10-fold above the normal level of abundance or activity of an aberrantly up-regulated imatinib resistance protein or less than 50%, 25%, 10% or 1% of the nomal level of an aberrantly down-regulated imatinib resistance protein.

In a specific embodiment, imatinib resistance is determined according to the expression levels of one or more genes selected from the group consisting of serine threonine kinases CTRL, MAP21K14, CLK3, MAP kinase MKNK2, the tyrosine kinase oncogene FYN, TCF7 (a putatively T cell specific transcription factor), guanine nucleotide binding proteins GNAZ and GNG11, and the MAF.

Such methods may, for example, utilize reagents such as nucleotide sequences and antibodies, e.g., the CML progression nucleotide sequences, and antibodies directed against CML progression proteins, including peptide fragments thereof. Specifically, such reagents may be used, for example, for: (1) the detection of the presence of mutations in a CML progression gene, or the detection of either over- or under-expression of a CML progression gene relative to the normal expression level; and (2) the detection of either an over- or an under-abundance of a CML progression protein relative to the normal CML progression protein level. These methods are also applicable to imatinib resistance genes and/or proteins.

The methods described herein may be performed, for example, by utilizing pre-packaged diagnostic kits comprising nucleic acid of at least one specific CML progression gene or an antibody that binds a CML progression/target protein or an IM resistance protein described herein, which may be conveniently used, e.g., in clinical settings, to diagnose patients exhibiting CML progression/target protein related disorder or abnormalities or exhibiting IM resistance.

For the detection of mutations in a CML progression/target gene or an IM resistance gene, any nucleated cell can be used as a starting source for genomic nucleic acid, e.g., bone marrow or peripheral blood. For the detection of expression of a CML progression/target gene or an IM resistance gene or CML progression/target gene or IM resistance gene products, any cell type or tissue in which the CML progression/target gene or the IM resistance gene is expressed may be utilized.

Nucleic acid-based detection techniques and peptide detection techniques are described in Section 5.3., infra. In one embodiment, the expression levels of one or more marker genes are measured using qRT-PCR.

5.2.3. Methods of Detecting CML Cells

The invention also provides diagnostic methods for the detection of CML cells, e.g., advanced phase CML hematopoetic stem cells and/or immature myeloid cells, by detecting a cell surface expressed CML progression protein (e.g., PRAME or CD47) or conserved variants or peptide fragments thereof, using, for example, immunoassays wherein the CML progression protein or conserved variants or peptide fragments are detected by their interaction with an anti-CML progression protein antibody.

For example, antibodies, or fragments of antibodies, such as those described in the present invention may be used to quantitatively or qualitatively detect advanced phase CML hematopoetic stem cells and/or immature myeloid cells by the presence of a CML progression protein or conserved variants or peptide fragments thereof on their surfaces. This can be accomplished, for example, by immunofluorescence techniques employing a fluorescently labeled antibody (see below, this Section) coupled with light microscopic, flow cytometric, or fluorimetric detection.

The antibodies (or fragments thereof) useful in the present invention may, additionally, be employed histologically, as in immunofluorescence or immunoelectron microscopy, for in situ detection of a CML progression protein or conserved variants or peptide fragments thereof. In situ detection may be accomplished by removing a histological specimen from a patient, e.g., bone marrow, and applying thereto a labeled antibody of the present invention. The antibody (or fragment) is preferably applied by overlaying the labeled antibody (or fragment) onto a biological sample. Through the use of such a procedure, it is possible to determine not only the presence of the CML progression protein, or conserved variants or peptide fragments, but also its distribution in the examined tissue. Using the present invention, those of ordinary skill will readily perceive that any of a wide variety of histological methods (such as staining procedures) can be modified in order to achieve such in situ detection.

Immunoassays for a CML progression protein or conserved variants or peptide fragments thereof will typically comprise incubating a sample, such as a biological fluid, a tissue extract, freshly harvested cells, or lysates of cells which have been incubated in cell culture, in the presence of a detectably labeled antibody capable of identifying A CML progression protein or conserved variants or peptide fragments thereof, and detecting the bound antibody by any of a number of techniques well-known in the art.

The biological sample may be brought in contact with and immobilized onto a solid phase support or carrier such as nitrocellulose, or other solid support which is capable of immobilizing cells, cell particles or soluble proteins. The support may then be washed with suitable buffers followed by treatment with the detectably labeled antibody specific for a CML progression protein. The solid phase support may then be washed with the buffer a second time to remove unbound antibody. The amount of bound label on solid support may then be detected by conventional means.

By "solid phase support or carrier" is intended any support capable of binding an antigen or an antibody. Well-known supports or carriers include glass, polystyrene, polypropylene, polyethylene, dextran, nylon, amylases, natural and modified celluloses, polyacrylamides, gabbros, and magnetite. The nature of the carrier can be either soluble to some extent or insoluble for the purposes of the present invention. The support material may have virtually any possible structural configuration so long as the coupled molecule is capable of binding to an antigen or antibody. Thus, the support configuration may be spherical, as in a bead, or cylindrical, as in the inside surface of a test tub, or the external surface of a rod. Alternatively, the surface may be flat such as a sheet, test strip, etc. Preferred supports include polystyrene beads. Those skilled in the art will know many other suitable carriers for binding antibody or antigen, or will be able to ascertain the same by use of routine experimentation.

The binding activity of a given lot of an antibody may be determined according to well known methods. Those skilled in the art will be able to determine operative and optimal assay conditions for each determination by employing routine experimentation.

One of the ways in which the antibody specific to a CML progression protein can be detectably labeled is by linking the same to an enzyme and use in an enzyme immunoassay (EIA) (Voller, A., "The Enzyme Linked Immunosorbent Assay (ELISA)", 1978, Diagnostic Horizons 2:1-7, Microbiological Associates Quarterly Publication, Walkersville, Md.); Voller, A. et al., 1978, J. Clin. Pathol. 31:507-520; Butler, J. E., 1981, Meth. Enzymol. 73:482-523; Maggio, E. (ed.), 1980, Enzyme Immunoassay, CRC Press, Boca Raton, Fla.; Ishikawa, E. et al., (eds.), 1981, Enzyme Immunoassay, Kgaku Shoin, Tokyo). The enzyme which is bound to the antibody will react with an appropriate substrate, preferably a chromogenic substrate, in such a manner as to produce a chemical moiety which can be detected, for example, by spectrophotometric, fluorimetric or by visual means. Enzymes which can be used to detectably label the antibody include, but are not limited to, malate dehydrogenase, staphylococcal nuclease, delta-5-steroid isomerase, yeast alcohol dehydrogenase, alpha-glycerophosphate, dehydrogenase, triose phosphate isomerase, horseradish peroxidase, alkaline phosphatase, asparaginase, glucose oxidase, beta-galactosidase, ribonuclease, urease, catalase, glucose-6-phosphate dehydrogenase, glucoamylase and acetylcholinesterase. The detection can be accomplished by colorimetric methods which employ a chromogenic substrate for the enzyme. Detection may also be accomplished by visual comparison of the extent of enzymatic reaction of a substrate in comparison with similarly prepared standards.

Detection may also be accomplished using any of a variety of other immunoassays. For example, by radioactively labeling the antibodies or antibody fragments, it is possible to detect a CML progression protein through the use of a radioimmunoassay (RIA) (see, for example, Weintraub, B., Principles of Radioimmunoassays, Seventh Training Course on Radioligand Assay Techniques, The Endocrine Society, March, 1986, which is incorporated by reference herein). The radioactive isotope can be detected by such means as the use of a gamma counter or a scintillation counter or by autoradiography.

It is also possible to label the antibody with a fluorescent compound. When the fluorescently labeled antibody is exposed to light of the proper wave length, its presence can then be detected due to fluorescence. Among the most commonly used fluorescent labeling compounds are fluorescein isothiocyanate, rhodamine, phycoerythrin, phycocyanin, allophycocyanin, o-phthaldehyde and fluorescamine.

The antibody can also be detectably labeled using fluorescence emitting metals such as $^{152}$Eu, or others of the lanthanide series. These metals can be attached to the antibody using such metal chelating groups as diethylenetriaminepentacetic acid (DTPA) or ethylenediaminetetraacetic acid (EDTA).

The antibody also can be detectably labeled by coupling it to a chemiluminescent compound. The presence of the chemiluminescent-tagged antibody is then determined by detecting the presence of luminescence that arises during the course of a chemical reaction. Examples of particularly useful chemiluminescent labeling compounds are luminol, isoluminol, theromatic acridinium ester, imidazole, acridinium salt and oxalate ester.

Likewise, a bioluminescent compound may be used to label the antibody of the present invention. Bioluminescence is a type of chemiluminescence found in biological systems in, which a catalytic protein increases the efficiency of the chemiluminescent reaction. The presence of a bioluminescent protein is determined by detecting the presence of luminescence. Important bioluminescent compounds for purposes of labeling are luciferin, luciferase and aequorin.

An antibody that is specific to a CML progression protein conjugated to detectable substances can be utilized to sort advanced phase CML cells from normal cells by methods known to those of skill in the art. In one embodiment, the advanced phase CML cells are sorted using a fluorescence activated cell sorter (FACS). Fluorescence activated cell sorting (FACS) is a well-known method for separating particles, including cells, based on the fluorescent properties of the particles (Kamarch, 1987, Methods Enzymol, 151:150-165). Laser excitation of fluorescent moieties in the individual particles results in a small electrical charge allowing electromagnetic separation of positive and negative particles from a mixture.

In one embodiment, cells, e.g, cells in bone marrow or peripheral blood, obtained from a patient, e.g., a human, are incubated with fluorescently labeled antibody specific for the CML progression protein for a time sufficient to allow the labeled antibodies to bind to the cells. In an alternative embodiment, such cells are incubated with the antibody, the cells are washed, and the cells are incubated with a second labeled antibody that recognizes the CML progression protein-specific antibody. In accordance with these embodiments, the cells are washed and processed through the cell sorter, allowing separation of cells that bind both antibodies to be separated from hybrid cells that do not bind both antibodies. FACS sorted particles may be directly deposited into individual wells of 96-well or 384-well plates to facilitate separation and further characterization.

5.2.4. Sample Collection

In the present invention, gene products, such as target polynucleotide molecules or proteins, are extracted from a sample taken from a CML patient. The sample may be collected in any clinically acceptable manner, but must be collected such that marker-derived polynucleotides (i.e., RNA) are preserved (if gene expression is to be measured) or proteins are preserved (if encoded proteins are to be measured). In one embodiment, bone marrow samples are used. In another embodiment, peripheral blood samples are used. In one embodiment, the pre-treatment bone marrow or peripheral blood sample from a patient is used. In another embodiment, the treatment bone marrow or peripheral blood sample from a patient after and/or during treatment is used. In one embodiment, the unsorted bone marrow or peripheral blood sample from a patient is used. In one embodiment, the unsorted bone marrow or peripheral blood sample from a clinical chronic phase patient is used. In another embodiment, the sorted bone marrow or peripheral blood sample from a patient after and/or during treatment is used. Other suitable samples may comprise any clinically relevant tissue sample, such as a tumor biopsy or fine needle aspirate, or a sample of body fluid, such as blood, plasma, serum, lymph, ascitic fluid, cystic fluid, or urine. The sample may be taken from a human, or, in a veterinary context, from non-human animals such as ruminants, horses, swine or sheep, or from domestic companion animals such as felines and canines.

In a specific embodiment, mRNA or nucleic acids derived therefrom (i.e., cDNA or amplified RNA or amplified DNA) are preferably labeled distinguishably from polynucleotide molecules of a reference sample, and both are simultaneously or independently hybridized to a microarray comprising some or all of the markers or marker sets or subsets described above. Alternatively, mRNA or nucleic acids derived therefrom may be labeled with the same label as the reference polynucleotide molecules, wherein the intensity of hybridization of each at a particular probe is compared.

Methods for preparing total and poly(A)+ RNA are well known and are described generally in Sambrook et al., MOLECULAR CLONING—A LABORATORY MANUAL (2ND ED.), Vols. 1-3, Cold Spring Harbor Laboratory, Cold Spring Harbor, N.Y. (1989)) and Ausubel et al., CURRENT PROTOCOLS IN MOLECULAR BIOLOGY, vol. 2, Current Protocols Publishing, New York (1994)). Preferably, total RNA, or total mRNA (poly(A)+ RNA) is measured in the methods of the invention directly or indirectly (e.g., via measuring cDNA or cRNA).

RNA may be isolated from eukaryotic cells by procedures that involve lysis of the cells and denaturation of the proteins contained therein. Cells of interest include wild-type cells (i.e., non-cancerous), drug-exposed wild-type cells, tumor- or tumor-derived cells, modified cells, normal or tumor cell line cells, and drug-exposed modified cells. Preferably, the cells are breast cancer tumor cells.

Additional steps may be employed to remove DNA. Cell lysis may be accomplished with a nonionic detergent, followed by microcentrifugation to remove the nuclei and hence the bulk of the cellular DNA. In one embodiment, RNA is extracted from cells of the various types of interest using guanidinium thiocyanate lysis followed by CsCl centrifugation to separate the RNA from DNA (Chirgwin et al., *Biochemistry* 18:5294-5299 (1979)). Poly(A)+ RNA is selected by selection with oligo-dT cellulose (see Sambrook et al., MOLECULAR CLONING—A LABORATORY MANUAL (2ND ED.), Vols. 1-3, Cold Spring Harbor Laboratory, Cold Spring Harbor, N.Y. (1989). Alternatively, separation of RNA from DNA can be accomplished by organic extraction, for example, with hot phenol or phenol/chloroform/isoamyl alcohol.

If desired, RNase inhibitors may be added to the lysis buffer. Likewise, for certain cell types, it may be desirable to add a protein denaturation/digestion step to the protocol.

For many applications, it is desirable to preferentially enrich mRNA with respect to other cellular RNAs, such as transfer RNA (tRNA) and ribosomal RNA (rRNA). Most mRNAs contain a poly(A) tail at their 3' end. This allows them to be enriched by affinity chromatography, for example, using oligo(dT) or poly(U) coupled to a solid support, such as cellulose or Sephadex™ (see Ausubel et al., CURRENT PROTOCOLS IN MOLECULAR BIOLOGY, vol. 2, Current Protocols Publishing, New York (1994). Once bound, poly(A)+ mRNA is eluted from the affinity column using 2 mM EDTA/0.1% SDS.

In a specific embodiment, total RNA or total mRNA from cells is used in the methods of the invention. The source of the RNA can be cells of an animal, e.g., human, mammal, primate, non-human animal, dog, cat, mouse, rat, bird, etc. In specific embodiments, the method of the invention is used with a sample containing total mRNA or total RNA from $1\times10^6$ cells or less. In another embodiment, proteins can be isolated from the foregoing sources, by methods known in the art, for use in expression analysis at the protein level.

Probes to the homologs of the marker sequences disclosed herein can be employed preferably when non-human nucleic acid is being assayed.

5.2.5. Determination of Abundance Levels of Gene Products

The abundance levels of the gene products of the genes in a sample may be determined by any means known in the art. The levels may be determined by isolating and determining the level (i.e., amount) of nucleic acid transcribed from each marker gene. Alternatively, or additionally, the level of specific proteins encoded by a marker gene may be determined.

The levels of transcripts of specific marker genes can be accomplished by determining the amount of mRNA, or polynucleotides derived therefrom, present in a sample. Any method for determining RNA levels can be used. For example, RNA is isolated from a sample and separated on an agarose gel. The separated RNA is then transferred to a solid support, such as a filter. Nucleic acid probes representing one or more markers are then hybridized to the filter by northern hybridization, and the amount of marker-derived RNA is determined. Such determination can be visual, or machine-aided, for example, by use of a densitometer. Another method of determining RNA levels is by use of a dot-blot or a slot-blot. In this method, RNA, or nucleic acid derived therefrom, from a sample is labeled. The RNA or nucleic acid derived therefrom is then hybridized to a filter containing oligonucleotides derived from one or more marker genes, wherein the oligonucleotides are placed upon the filter at discrete, easily-identifiable locations. Hybridization, or lack thereof, of the labeled RNA to the filter-bound oligonucleotides is determined visually or by densitometer. Polynucleotides can be labeled using a radiolabel or a fluorescent (i.e., visible) label.

The levels of transcripts of particular marker genes may also be assessed by determining the level of the specific protein expressed from the marker genes. This can be accomplished, for example, by separation of proteins from a sample on a polyacrylamide gel, followed by identification of specific marker-derived proteins using antibodies in a western blot. Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al, 1990, GEL ELECTROPHORESIS OF PROTEINS: A PRACTICAL APPROACH, IRL Press, New York; Shevchenko et al., *Proc. Nat'l Acad. Sci.* USA 93:1440-1445 (1996); Sagliocco et al., *Yeast* 12:1519-1533 (1996); Lander, *Science* 274:536-539 (1996). The resulting electropherograms can be analyzed by numerous techniques, including mass spectrometric techniques, western blotting and immunoblot analysis using polyclonal and monoclonal antibodies.

Alternatively, marker-derived protein levels can be determined by constructing an antibody microarray in which binding sites comprise immobilized, preferably monoclonal, antibodies specific to a plurality of protein species encoded by the cell genome. Preferably, antibodies are present for a substantial fraction of the marker-derived proteins of interest. Methods for making monoclonal antibodies are well known (see, e.g., Harlow and Lane, 1988, ANTIBODIES: A LABORATORY MANUAL, Cold Spring Harbor, N.Y., which is incorporated in its entirety for all purposes). In one embodiment, monoclonal antibodies are raised against synthetic peptide fragments designed based on genomic sequence of the cell. With such an antibody array, proteins from the cell are contacted to the array, and their binding is assayed with assays known in the art. Generally, the expression, and the level of expression, of proteins of diagnostic or prognostic interest can be detected through immunohistochemical staining of tissue slices or sections.

Finally, levels of transcripts of marker genes in a number of tissue specimens may be characterized using a "tissue array" (Kononen et al., *Nat. Med* 4(7):844-7 (1998)). In a tissue array, multiple tissue samples are assessed on the same microarray. The arrays allow in situ detection of RNA and protein levels; consecutive sections allow the analysis of multiple samples simultaneously.

5.2.5.1. Microarrays

In preferred embodiments, polynucleotide microarrays are used to measure expression so that the expression status of each of the markers above is assessed simultaneously. Generally, microarrays according to the invention comprise a plurality of markers informative for clinical category determination, for a particular disease or condition.

The invention also provides a microarray comprising for each of a plurality of genes, said genes being all or at least 5, 10, 20, 30, 40, 50, 70, 100 or 200 of the genes listed in Tables 1a and/or 1b or any of Tables 2a-2b, 4 and 5a-5b, or all or at least 5, 10, or 15 of the genes listed in Table 3, one or more polynucleotide probes complementary and hybridizable to a sequence in said gene, wherein polynucleotide probes complementary and hybridizable to said genes constitute at least 50%, 60%, 70%, 80%, 90%, 95%, or 98% of the probes on said microarray. In a particular embodiment, the invention provides such a microarray wherein the plurality of genes comprises the 20 genes listed in Table 3 or the 228 genes listed in Table 4 or the 368 genes listed in Tables 5a and 5b. The microarray can be in a sealed container.

The microarrays preferably comprise at least 2, 3, 4, 5, 7, 10, 15, 20, 25, 30, 35, 40, 45, 50, 75, 100, 150, 200 or more of markers, or all of the markers, or any combination of markers, identified as informative for CML progression and/or imatinib resistance, e.g., within Tables 1a and 1b or any of Tables 2a-2b, 3, 4, and 5a-5b. The actual number of informative markers the microarray comprises will vary depending upon the particular condition of interest.

In other embodiments, the invention provides polynucleotide arrays in which the CML progression markers comprise at least 50%, 60%, 70%, 80%, 85%, 90%, 95% or 98% of the probes on the array. In another specific embodiment, the microarray comprises a plurality of probes, wherein said plurality of probes comprise probes complementary and hybridizable to at least 75% of the CML progression markers.

General methods pertaining to the construction of microarrays comprising the marker sets and/or subsets above are described in the following sections.

5.2.5.2. Construction of Microarrays

Microarrays are prepared by selecting probes which comprise a polynucleotide sequence, and then immobilizing such probes to a solid support or surface. For example, the probes may comprise DNA sequences, RNA sequences, or copolymer sequences of DNA and RNA. The polynucleotide sequences of the probes may also comprise DNA and/or RNA analogues, or combinations thereof. For example, the polynucleotide sequences of the probes may be full or partial fragments of genomic DNA. The polynucleotide sequences of the probes may also be synthesized nucleotide sequences, such as synthetic oligonucleotide sequences. The probe sequences can be synthesized either enzymatically in vivo, enzymatically in vitro (e.g., by PCR), or non-enzymatically in vitro.

The probe or probes used in the methods of the invention are preferably immobilized to a solid support which may be either porous or non-porous. For example, the probes may be polynucleotide sequences which are attached to a nitrocellulose or nylon membrane or filter covalently at either the 3' or the 5' end of the polynucleotide. Such hybridization probes are well known in the art (see, e.g., Sambrook et al., MOLECULAR CLONING—A LABORATORY MANUAL (2ND ED.), Vols. 1-3, Cold Spring Harbor Laboratory, Cold Spring Harbor, N.Y. (1989). Alternatively, the solid support or surface may be a glass or plastic surface. In a particularly preferred embodiment, hybridization levels are measured to microarrays of probes consisting of a solid phase on the surface of which are immobilized a population of polynucleotides, such as a population of DNA or DNA mimics, or, alternatively, a population of RNA or RNA mimics. The solid phase may be a nonporous or, optionally, a porous material such as a gel.

In preferred embodiments, a microarray comprises a support or surface with an ordered array of binding (e.g., hybridization) sites or "probes" each representing one of the markers described herein. Preferably the microarrays are addressable arrays, and more preferably positionally addressable arrays. More specifically, each probe of the array is preferably located at a known, predetermined position on the solid support such that the identity (i.e., the sequence) of each probe can be determined from its position in the array (i.e., on the support or surface). In preferred embodiments, each probe is covalently attached to the solid support at a single site.

Microarrays can be made in a number of ways, of which several are described below. However produced, microarrays share certain characteristics. The arrays are reproducible, allowing multiple copies of a given array to be produced and easily compared with each other. Preferably, microarrays are made from materials that are stable under binding (e.g., nucleic acid hybridization) conditions. The microarrays are preferably small, e.g., between 1 cm$^2$ and 25 cm$^2$, between 12 cm$^2$ and 13 cm$^2$, or 3 cm$^2$. However, larger arrays are also contemplated and may be preferable, e.g., for use in screening arrays. Preferably, a given binding site or unique set of binding sites in the microarray will specifically bind (e.g., hybridize) to the product of a single gene in a cell (e.g., to a specific mRNA, or to a specific cDNA derived therefrom). However, in general, other related or similar sequences will cross hybridize to a given binding site.

The microarrays of the present invention include one or more test probes, each of which has a polynucleotide sequence that is complementary to a subsequence of RNA or DNA to be detected. Preferably, the position of each probe on the solid surface is known. Indeed, the microarrays are preferably positionally addressable arrays. Specifically, each probe of the array is preferably located at a known, predetermined position on the solid support such that the identity (i.e., the sequence) of each probe can be determined from its position on the array (i.e., on the support or surface).

According to the invention, the microarray is an array (i.e., a matrix) in which each position represents one of the markers described herein. For example, each position can contain a DNA or DNA analogue based on genomic DNA to which a particular RNA or cDNA transcribed from that genetic marker can specifically hybridize. The DNA or DNA analogue can be, e.g., a synthetic oligomer or a gene fragment. In one embodiment, probes representing each of the markers are present on the array. In a preferred embodiment, the array comprises probes for each of the markers listed in Tables 1a and/or 1b or any one of Tables 2a-2b, 3, 4, and 5a-5b.

5.2.5.3. Preparing Probes for Microarrays

As noted above, the "probe" to which a particular polynucleotide molecule specifically hybridizes according to the invention contains a complementary genomic polynucleotide sequence. The probes of the microarray preferably consist of nucleotide sequences of no more than 1,000 nucleotides. In some embodiments, the probes of the array consist of nucleotide sequences of 10 to 1,000 nucleotides. In a preferred embodiment, the nucleotide sequences of the probes are in the range of 10-200 nucleotides in length and are genomic sequences of a species of organism, such that a plurality of different probes is present, with sequences complementary and thus capable of hybridizing to the genome of such a species of organism, sequentially tiled across all or a portion of such genome. In other specific embodiments, the probes are in the range of 10-30 nucleotides in length, in the range of 10-40 nucleotides in length, in the range of 20-50 nucleotides in length, in the range of 40-80 nucleotides in length, in the range of 50-150 nucleotides in length, in the range of 80-120 nucleotides in length, and most preferably are 60 nucleotides in length.

The probes may comprise DNA or DNA "mimics" (e.g., derivatives and analogues) corresponding to a portion of an organism's genome. In another embodiment, the probes of the microarray are complementary RNA or RNA mimics. DNA mimics are polymers composed of subunits capable of specific, Watson-Crick-like hybridization with DNA, or of specific hybridization with RNA. The nucleic acids can be modified at the base moiety, at the sugar moiety, or at the phosphate backbone. Exemplary DNA mimics include, e.g., phosphorothioates.

DNA can be obtained, e.g., by polymerase chain reaction (PCR) amplification of genomic DNA or cloned sequences. PCR primers are preferably chosen based on a known sequence of the genome that will result in amplification of specific fragments of genomic DNA. Computer programs that are well known in the art are useful in the design of primers with the required specificity and optimal amplification properties, such as Oligo version 5.0 (National Biosciences). Typically each probe on the microarray will be between 10 bases and 50,000 bases, usually between 300 bases and 1,000 bases in length. PCR methods are well known in the art, and are described, for example, in Innis et al., eds., PCR PROTOCOLS: A GUIDE TO METHODS AND APPLICATIONS, Academic Press Inc., San Diego, Calif. (1990). It will be apparent to one skilled in the art that controlled robotic systems are useful for isolating and amplifying nucleic acids.

An alternative, preferred means for generating the polynucleotide probes of the microarray is by synthesis of synthetic polynucleotides or oligonucleotides, e.g., using N-phosphonate or phosphoramidite chemistries (Froehler et al., *Nucleic Acid Res.* 14:5399-5407 (1986); McBride et al., *Tetrahedron Lett.* 24:246-248 (1983)). Synthetic sequences are typically between about 10 and about 500 bases in length, more typically between about 20 and about 100 bases, and most preferably between about 40 and about 70 bases in length. In some embodiments, synthetic nucleic acids include non-natural bases, such as, but by no means limited to, inosine. As noted above, nucleic acid analogues may be used as binding sites for hybridization. An example of a suitable nucleic acid analogue is peptide nucleic acid (see, e.g., Egholm et al., *Nature* 363:566-568 (1993); U.S. Pat. No. 5,539,083).

Probes are preferably selected using an algorithm that takes into account binding energies, base composition, sequence complexity, cross-hybridization binding energies, and secondary structure. See Friend et al., International Patent Publication WO 01/05935, published Jan. 25, 2001; Hughes et al., *Nat. Biotech.* 19:342-7 (2001).

A skilled artisan will also appreciate that positive control probes, e.g., probes known to be complementary and hybridizable to sequences in the target polynucleotide molecules, and negative control probes, e.g., probes known to not be complementary and hybridizable to sequences in the target polynucleotide molecules, should be included on the array. In one embodiment, positive controls are synthesized along the perimeter of the array. In another embodiment, positive controls are synthesized in diagonal stripes across the array. In still another embodiment, the reverse complement for each probe is synthesized next to the position of the probe to serve as a negative control. In yet another embodiment, sequences from other species of organism are used as negative controls or as "spike-in" controls.

5.2.5.4. Attaching Probes to the Solid Surface

The probes are attached to a solid support or surface, which may be made, e.g., from glass, plastic (e.g., polypropylene, nylon), polyacrylamide, nitrocellulose, gel, or other porous or nonporous material. A preferred method for attaching the nucleic acids to a surface is by printing on glass plates, as is described generally by Schena et al, *Science* 270:467-470 (1995). This method is especially useful for preparing microarrays of cDNA (See also, DeRisi et al, *Nature Genetics* 14:457-460 (1996); Shalon et al., *Genome Res.* 6:639-645 (1996); and Schena et al., *Proc. Natl. Acad. Sci. U.S.A.* 93:10539-11286 (1995)).

A second preferred method for making microarrays is by making high-density oligonucleotide arrays. Techniques are known for producing arrays containing thousands of oligonucleotides complementary to defined sequences, at defined locations on a surface using photolithographic techniques for synthesis in situ (see, Fodor et al., 1991, *Science* 251:767-773; Pease et al., 1994, *Proc. Natl. Acad. Sci. U.S.A.* 91:5022-5026; Lockhart et al., 1996, *Nature Biotechnology* 14:1675; U.S. Pat. Nos. 5,578,832; 5,556,752; and 5,510,270) or other methods for rapid synthesis and deposition of defined oligonucleotides (Blanchard et al., *Biosensors & Bioelectronics* 11:687-690). When these methods are used, oligonucleotides (e.g., 60-mers) of known sequence are synthesized directly on a surface such as a derivatized glass slide. Usually, the array produced is redundant, with several oligonucleotide molecules per RNA.

Other methods for making microarrays, e.g., by masking (Maskos and Southern, 1992, *Nuc. Acids. Res.* 20:1679-1684), may also be used. In principle, and as noted supra, any type of array, for example, dot blots on a nylon hybridization membrane (see Sambrook et al., MOLECULAR CLONING—A LABORATORY MANUAL (2ND ED.), Vols. 1-3, Cold Spring Harbor Laboratory, Cold Spring Harbor, N.Y. (1989)) could be used. However, as will be recognized by those skilled in the art, very small arrays will frequently be preferred because hybridization volumes will be smaller.

In one embodiment, the arrays of the present invention are prepared by synthesizing polynucleotide probes on a support. In such an embodiment, polynucleotide probes are attached to the support covalently at either the 3' or the 5' end of the polynucleotide.

In a particularly preferred embodiment, microarrays are manufactured by means of an ink jet printing device for oligonucleotide synthesis, e.g., using the methods and systems described by Blanchard in U.S. Pat. No. 6,028,189; Blanchard et al., 1996, *Biosensors and Bioelectronics* 11:687-690; Blanchard, 1998, in Synthetic DNA Arrays in Genetic Engineering, Vol. 20, J. K. Setlow, Ed., Plenum Press, New York at pages 111-123. Specifically, the oligonucleotide probes in such microarrays are preferably synthesized in arrays, e.g., on a glass slide, by serially depositing individual nucleotide bases in "microdroplets" of a high surface tension solvent such as propylene carbonate. The microdroplets have small volumes (e.g., 100 pL or less, more preferably 50 pL or less) and are separated from each other on the microarray (e.g., by hydrophobic domains) to form circular surface tension wells which define the locations of the array elements (i.e., the different probes). Microarrays manufactured by this ink-jet method are typically of high density, preferably having a density of at least about 2,500 different probes per 1 cm$^2$. The polynucleotide probes are attached to the support covalently at either the 3' or the 5' end of the polynucleotide.

5.2.5.5. Target Labeling and Hybridization to Microarrays

The polynucleotide molecules which may be analyzed by the present invention (the "target polynucleotide molecules") may be from any clinically relevant source, but are expressed RNA or a nucleic acid derived therefrom (e.g., cDNA or amplified RNA derived from cDNA that incorporates an RNA polymerase promoter), including naturally occurring nucleic acid molecules, as well as synthetic nucleic acid molecules. In one embodiment, the target polynucleotide molecules comprise RNA, including, but by no means limited to, total cellular RNA, poly(A)$^+$ messenger RNA (mRNA) or fraction thereof, cytoplasmic mRNA, or RNA transcribed from cDNA (i.e., cRNA; see, e.g., Linsley & Schelter, U.S. patent application Ser. No. 09/411,074, filed Oct. 4, 1999, or U.S. Pat. No. 5,545,522, 5,891,636, or 5,716,785). Methods for preparing total and poly(A)$^+$ RNA are well known in the art, and are described generally, e.g., in Sambrook et al., MOLECULAR CLONING—A LABORATORY MANUAL (2ND ED.), Vols. 1-3, Cold Spring Harbor Laboratory, Cold Spring Harbor, N.Y. (1989). In one embodiment, RNA is extracted from cells of the various types of interest in this invention using guanidinium thiocyanate lysis followed by CsCl centrifugation (Chirgwin et al., 1979, *Biochemistry* 18:5294-5299). In another embodiment, total RNA is extracted using a silica gel-based column, commercially available examples of which include RNeasy (Qiagen, Valencia, Calif.) and StrataPrep (Stratagene, La Jolla, Calif.). In an alternative embodiment, which is preferred for *S. cerevisiae*, RNA is extracted from cells using phenol and chloroform, as described in Ausubel et al., eds., 1989, CURRENT PROTOCOLS IN MOLECULAR BIOLOGY, Vol. III, Green Publishing Associates, Inc., John Wiley & Sons, Inc., New York, at pp. 13.12.1-13.12.5). Poly(A)$^+$ RNA can be selected, e.g., by selection with oligo-dT cellulose or, alternatively, by oligo-dT primed reverse transcription of total cellular RNA. In one embodiment, RNA can be fragmented by methods known in the art, e.g., by incubation with ZnCl$_2$, to generate fragments of RNA. In another embodiment, the polynucleotide molecules analyzed by the invention comprise cDNA, or PCR products of amplified RNA or cDNA.

In one embodiment, total RNA, mRNA, or nucleic acids derived therefrom, is isolated from a sample taken from a CML patient. Target polynucleotide molecules that are poorly expressed in particular cells may be enriched using normalization techniques (Bonaldo et al., 1996, *Genome Res.* 6:791-806).

As described above, the target polynucleotides are detectably labeled at one or more nucleotides. Any method known in the art may be used to detectably label the target polynucleotides. Preferably, this labeling incorporates the label uniformly along the length of the RNA, and more preferably, the labeling is carried out at a high degree of efficiency. One embodiment for this labeling uses oligo-dT primed reverse transcription to incorporate the label; however, conventional methods of this method are biased toward generating 3' end fragments. Thus, in a preferred embodiment, random primers (e.g., 9-mers) are used in reverse transcription to uniformly incorporate labeled nucleotides over the full length of the target polynucleotides. Alternatively, random primers may be used in conjunction with PCR methods or T7 promoter-based in vitro transcription methods in order to amplify the target polynucleotides.

In a preferred embodiment, the detectable label is a luminescent label. For example, fluorescent labels, bioluminescent labels, chemiluminescent labels, and colorimetric labels may be used in the present invention. In a highly preferred embodiment, the label is a fluorescent label, such as a fluorescein, a phosphor, a rhodamine, or a polymethine dye derivative. Examples of commercially available fluorescent labels include, for example, fluorescent phosphoramidites such as FluorePrime (Amersham Pharmacia, Piscataway, N.J.), Fluoredite (Miilipore, Bedford, Mass.), FAM (ABI, Foster City, Calif.), and Cy3 or Cy5 (Amersham Pharmacia, Piscataway, N.J.). In another embodiment, the detectable label is a radiolabeled nucleotide.

In a further preferred embodiment, target polynucleotide molecules from a patient sample are labeled differentially from target polynucleotide molecules of a reference sample. The reference can comprise target polynucleotide molecules from normal cell samples (i.e., cell sample, e.g., bone marrow or peripheral blood, from those not afflicted with CML) or from cell samples, e.g., bone marrow or peripheral blood, from chronic phase CML patients.

Nucleic acid hybridization and wash conditions are chosen so that the target polynucleotide molecules specifically bind or specifically hybridize to the complementary polynucleotide sequences of the array, preferably to a specific array site, wherein its complementary DNA is located.

Arrays containing double-stranded probe DNA situated thereon are preferably subjected to denaturing conditions to render the DNA single-stranded prior to contacting with the target polynucleotide molecules. Arrays containing single-stranded probe DNA (e.g., synthetic oligodeoxyribonucleic acids) may need to be denatured prior to contacting with the target polynucleotide molecules, e.g., to remove hairpins or dimers which form due to self complementary sequences.

Optimal hybridization conditions will depend on the length (e.g., oligomer versus polynucleotide greater than 200 bases) and type (e.g., RNA, or DNA) of probe and target nucleic acids. One of skill in the art will appreciate that as the oligonucleotides become shorter, it may become necessary to adjust their length to achieve a relatively uniform melting temperature for satisfactory hybridization results. General parameters for specific (i.e., stringent) hybridization conditions for nucleic acids are described in Sambrook et al., MOLECULAR CLONING—A LABORATORY MANUAL (2ND ED.), Vols. 1-3, Cold Spring Harbor Laboratory, Cold Spring Harbor, N.Y. (1989), and in Ausubel et al., CURRENT PROTOCOLS IN MOLECULAR BIOLOGY, vol. 2, Current Protocols Publishing, New York (1994). Typical hybridization conditions for the cDNA microarrays of Schena et al. are hybridization in 5×SSC plus 0.2% SDS at 65° C. for four hours, followed by washes at 25° C. in low stringency wash buffer (1×SSC plus 0.2% SDS), followed by 10 minutes at 25° C. in higher stringency wash buffer (0.1×SSC plus 0.2% SDS) (Schena et al., Proc. Natl. Acad. Sci. U.S.A. 93:10614 (1993)). Useful hybridization conditions are also provided in, e.g., Tijessen, 1993, HYBRIDIZATION WITH NUCLEIC ACID PROBES, Elsevier Science Publishers B.V.; and Kricka, 1992, NONISOTOPIC DNA PROBE TECHNIQUES, Academic Press, San Diego, Calif.

Particularly preferred hybridization conditions include hybridization at a temperature at or near the mean melting temperature of the probes (e.g., within 51° C., more preferably within 21° C.) in 1 M NaCl, 50 mM MES buffer (pH 6.5), 0.5% sodium sarcosine and 30% formamide.

5.2.5.6. Signal Detection and Data Analysis

When fluorescently labeled gene products are used, the fluorescence emissions at each site of a microarray may be, preferably, detected by scanning confocal laser microscopy. In one embodiment, a separate scan, using the appropriate excitation line, is carried out for each of the two fluorophores used. Alternatively, a laser may be used that allows simultaneous specimen illumination at wavelengths specific to the two fluorophores and emissions from the two fluorophores can be analyzed simultaneously (see Shalon et al., 1996, "A DNA microarray system for analyzing complex DNA samples using two-color fluorescent probe hybridization," Genome Research 6:639-645, which is incorporated by reference in its entirety for all purposes). In a preferred embodiment, the arrays are scanned with a laser fluorescent scanner with a computer controlled X-Y stage and a microscope objective. Sequential excitation of the two fluorophores is achieved with a multi-line, mixed gas laser and the emitted light is split by wavelength and detected with two photomultiplier tubes. Fluorescence laser scanning devices are described in Schena et al., Genome Res. 6:639-645 (1996), and in other references cited herein. Alternatively, the fiber-optic bundle described by Ferguson et al., Nature Biotech. 14:1681-1684 (1996), may be used to monitor mRNA abundance levels at a large number of sites simultaneously.

5.2.5.7. Other Assays for Detecting and Quantifying RNA

In addition to microarrays such as those described above any technique known to one of skill for detecting and measuring RNA can be used in accordance with the methods of the invention. Non-limiting examples of techniques include Northern blotting, nuclease protection assays, RNA fingerprinting, polymerase chain reaction, ligase chain reaction, Qbeta replicase, isothermal amplification method, strand displacement amplification, transcription based amplification systems, nuclease protection (S1 nuclease or RNAse protection assays), SAGE as well as methods disclosed in International Publication Nos. WO 88/10315 and WO 89/06700, and International Applications Nos. PCT/US87/00880 and PCT/US89/01025.

A standard Northern blot assay can be used to ascertain an RNA transcript size, identify alternatively spliced RNA transcripts, and the relative amounts of mRNA in a sample, in accordance with conventional Northern hybridization techniques known to those persons of ordinary skill in the art. In Northern blots, RNA samples are first separated by size via electrophoresis in an agarose gel under denaturing conditions. The RNA is then transferred to a membrane, crosslinked and hybridized with a labeled probe. Nonisotopic or high specific activity radiolabeled probes can be used including random-primed, nick-translated, or PCR-generated DNA probes, in vitro transcribed RNA probes, and oligonucleotides. Additionally, sequences with only partial homology (e.g., cDNA from a different species or genomic DNA fragments that might contain an exon) may be used as probes. The labeled probe, e.g., a radiolabelled cDNA, either containing the full-length, single stranded DNA or a fragment of that DNA sequence may be at least 20, at least 30, at least 50, or at least 100 consecutive nucleotides in length. The probe can be labeled by any of the many different methods known to those skilled in this art. The labels most commonly employed for these studies are radioactive elements, enzymes, chemicals that fluoresce when exposed to ultraviolet light, and others. A number of fluorescent materials are known and can be utilized as labels. These include, but are not limited to, fluorescein, rhodamine, auramine, Texas Red, AMCA blue and Lucifer Yellow. A particular detecting material is anti-rabbit antibody prepared in goats and conjugated with fluorescein through an isothiocyanate. Proteins can also be labeled with a radioactive element or with an enzyme. The radioactive label can be detected by any of the currently available counting procedures. Non-limiting examples of isotopes include $^3$H, $^{14}$C, $^{32}$P, $^{35}$S, $^{36}$Cl, $^{35}$Cr, $^{57}$Co, $^{58}$Co, $^{59}$Fe, $^{90}$Y, $^{125}$I, $^{131}$I, and $^{186}$Re. Enzyme labels are likewise useful, and can be detected by any of the presently utilized colorimetric, spectrophotometric, fluorospectrophotometric, amperometric or gasometric techniques. The enzyme is conjugated to the selected particle by reaction with bridging molecules such as carbodiimides, diisocyanates, glutaraldehyde and the like. Any enzymes known to one of skill in the art can be utilized. Examples of such enzymes include, but are not limited to, peroxidase, beta-D-galactosidase, urease, glucose oxidase plus peroxidase and alkaline phosphatase. U.S. Pat. Nos. 3,654,090, 3,850,752, and 4,016,043 are referred to by way of example for their disclosure of alternate labeling material and methods.

Nuclease protection assays (including both ribonuclease protection assays and S1 nuclease assays) can be used to detect and quantitate specific mRNAs. In nuclease protection assays, an antisense probe (labeled with, e.g., radiolabeled or nonisotopic) hybridizes in solution to an RNA sample. Following hybridization, single-stranded, unhybridized probe and RNA are degraded by nucleases. An acrylamide gel is used to separate the remaining protected fragments. Typically, solution hybridization is more efficient than membrane-based hybridization, and it can accommodate up to 100 μg of sample RNA, compared with the 20-30 μg maximum of blot hybridizations.

The ribonuclease protection assay, which is the most common type of nuclease protection assay, requires the use of RNA probes. Oligonucleotides and other single-stranded DNA probes can only be used in assays containing S1 nuclease. The single-stranded, antisense probe must typically be completely homologous to target RNA to prevent cleavage of the probe:target hybrid by nuclease.

Serial Analysis Gene Expression (SAGE), which is described in e.g., Velculescu et al., 1995, Science 270:484-7;

Carulli, et al., 1998, *Journal of Cellular Biochemistry Supplements* 30/31:286-96, can also be used to determine RNA abundances in a cell sample.

Quantitative reverse transcriptase PCR (qRT-PCR) can also be used to determine the expression profiles of marker genes (see, e.g., U.S. Patent Application Publication No. 2005/0048542A1). The first step in gene expression profiling by RT-PCR is the reverse transcription of the RNA template into cDNA, followed by its exponential amplification in a PCR reaction. The two most commonly used reverse transcriptases are avilo myeloblastosis virus reverse transcriptase (AMV-RT) and Moloney murine leukemia virus reverse transcriptase (MLV-RT). The reverse transcription step is typically primed using specific primers, random hexamers, or oligo-dT primers, depending on the circumstances and the goal of expression profiling. For example, extracted RNA can be reverse-transcribed using a GeneAmp RNA PCR kit (Perkin Elmer, Calif., USA), following the manufacturer's instructions. The derived cDNA can then be used as a template in the subsequent PCR reaction.

Although the PCR step can use a variety of thermostable DNA-dependent DNA polymerases, it typically employs the Taq DNA polymerase, which has a 5'-3' nuclease activity but lacks a 3'-5' proofreading endonuclease activity. Thus, TaqMan® PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon typical of a PCR reaction. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

TaqMan® RT-PCR can be performed using commercially available equipment, such as, for example, ABI PRISM 7700™ Sequence Detection System™ (Perkin-Elmer-Applied Biosystems, Foster City, Calif., USA), or Lightcycler (Roche Molecular Biochemicals, Mannheim, Germany). In a preferred embodiment, the 5' nuclease procedure is run on a real-time quantitative PCR device such as the ABI PRISM 7700™ Sequence Detection System™. The system consists of a thermocycler, laser, charge-coupled device (CCD), camera and computer. The system includes software for running the instrument and for analyzing the data.

5'-Nuclease assay data are initially expressed as Ct, or the threshold cycle. Fluorescence values are recorded during every cycle and represent the amount of product amplified to that point in the amplification reaction. The point when the fluorescent signal is first recorded as statistically significant is the threshold cycle (Ct).

To minimize errors and the effect of sample-to-sample variation, RT-PCR is usually performed using an internal standard. The ideal internal standard is expressed at a constant level among different tissues, and is unaffected by the experimental treatment. RNAs most frequently used to normalize patterns of gene expression are mRNAs for the housekeeping genes glyceraldehyde-3-phosphate-dehydrogenase (GAPDH) and β-actin.

A more recent variation of the RT-PCR technique is the real time quantitative PCR, which measures PCR product accumulation through a dual-labeled fluorigenic probe (i.e., TaqMan® probe). Real time PCR is compatible both with quantitative competitive PCR, where internal competitor for each target sequence is used for normalization, and with quantitative comparative PCR using a normalization gene contained within the sample, or a housekeeping gene for RT-PCR. For further details see, e.g. Held et al., Genome Research 6:986-994 (1996).

5.2.5.8. Detection and Quantification of Protein

Measurement of the translational state may be performed according to several methods. For example, whole genome monitoring of protein (e.g., the "proteome,") can be carried out by constructing a microarray in which binding sites comprise immobilized, preferably monoclonal, antibodies specific to a plurality of protein species encoded by the cell genome. Preferably, antibodies are present for a substantial fraction of the encoded proteins, or at least for those proteins relevant to the action of a drug of interest. Methods for making monoclonal antibodies are well known (see, e.g., Harlow and Lane, 1988, *Antibodies: A Laboratory Manual*, Cold Spring Harbor, N.Y., which is incorporated in its entirety for all purposes). In one embodiment, monoclonal antibodies are raised against synthetic peptide fragments designed based on genomic sequence of the cell. With such an antibody array, proteins from the cell are contacted to the array and their binding is assayed with assays known in the art.

Immunoassays known to one of skill in the art can be used to detect and quantify protein levels. For example, ELISAs can be used to detect and quantify protein levels. ELISAs comprise preparing antigen, coating the well of a 96 well microtiter plate with the antigen, adding the antibody of interest conjugated to a detectable compound such as an enzymatic substrate (e.g., horseradish peroxidase or alkaline phosphatase) to the well and incubating for a period of time, and detecting the presence of the antigen. In ELISAs the antibody of interest does not have to be conjugated to a detectable compound; instead, a second antibody (which recognizes the antibody of interest) conjugated to a detectable compound may be added to the well. Further, instead of coating the well with the antigen, the antibody may be coated to the well. In this case, a second antibody conjugated to a detectable compound may be added following the addition of the antigen of interest to the coated well. One of skill in the art would be knowledgeable as to the parameters that can be modified to increase the signal detected as well as other variations of ELISAs known in the art. In a preferred embodiment, an ELISA may be performed by coating a high binding 96-well microtiter plate (Costar) with 2 μg/ml of rhu-IL-9 in PBS overnight. Following three washes with PBS, the plate is incubated with three-fold serial dilutions of Fab at 25° C. for 1 hour. Following another three washes of PBS, 1 μg/ml anti-human kappa-alkaline phosphatase-conjugate is added and the plate is incubated for 1 hour at 25° C. Following three washes with PBST, the alkaline phosphatase activity is determined in 50 μl/AMP/PPMP substrate. The reactions are stopped and the absorbance at 560 nm is determined with a VMAX microplate reader. For further discussion regarding ELISAs see, e.g., Ausubel et al, eds, 1994, Current Protocols in Molecular Biology, Vol. 1, John Wiley & Sons, Inc., New York at 11.2.1.

Protein levels may be determined by Western blot analysis. Further, protein levels as well as the phosphorylation of proteins can be determined by immunoprecitation followed by Western blot analysis. Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the antibody of interest to the cell lysate, incubating for a period of time (e.g., 1 to 4 hours) at 40° C., adding protein A and/or protein G sepharose beads to the cell lysate, incubating for about an hour or more at 40° C., washing the beads in lysis buffer and resuspending the beads in SDS/sample buffer. The ability of the antibody of interest to immunoprecipitate a particular antigen can be assessed by, e.g., western blot analysis. One of skill in the art would be knowledgeable as to the parameters that can be modified to increase the binding of the antibody to an antigen and decrease the background (e.g., pre-clearing the cell lysate with sepharose beads). For further discussion regarding immunoprecipitation protocols see, e.g., Ausubel et al, eds, 1994, Current Protocols in Molecular Biology, Vol. 1, John Wiley & Sons, Inc., New York at 10.16.1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, incubating the membrane in blocking solution (e.g., PBS with 3% BSA or non-fat milk), washing the membrane in washing buffer (e.g., PBS-Tween 20), incubating the membrane with primary antibody (the antibody of interest) diluted in blocking buffer, washing the membrane in washing buffer, incubating the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{32}P$ or $^{125}I$) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

Protein expression levels can also be separated by two-dimensional gel electrophoresis systems. Two-dimensional gel electrophoresis is well-known in the art and typically involves iso-electric focusing along a first dimension followed by SDS-PAGE electrophoresis along a second dimension. See, e.g., Hames et al., 1990, *Gel Electrophoresis of proteins: A Practical Approach*, IRL Press, New York; Shevchenko et al., 1996, *Proc. Natl. Acad. Sci. USA* 93:1440-1445; Sagliocco et al., 1996, *Yeast* 12:1519-1533; Lander, 1996, *Science* 274:536-539. The resulting electropherograms can be analyzed by numerous techniques, including mass spectrometric techniques, Western blotting and immunoblot analysis using polyclonal and monoclonal antibodies, and internal and N-terminal micro-sequencing.

5.3. Treating CML by Modulating Expression and/or Activity of CML Progression Genes and/or Their Products The invention provides methods and compositions for utilizing CML target genes listed in Table 3 or 5a or 5b and or imatinib resistance genes listed in Table 4 in treating CML. The methods and compositions are used for treating CML patient exhibiting aberrant regulation of one or more CML target/progression genes or IM resistance genes by modulating the expression and/or activity of such genes and/or the encoded proteins. The methods and composition can be used in conjunction with other CML treatment, e.g., imatinib mesylate. The compositions (e.g., agents that modulate expression and/or activity of the CML target gene or gene product) of the invention are preferably purified. In the following, for simplicity reasons, the methods are often described with reference to CML target gene(s). It will be understood that the methods are equally applicable to CML progression genes and IM resistance genes.

In one embodiment, the invention provides methods and compositions for treating a CML patient exhibiting an aberrant up-regulation of a CML target gene by reducing the expression and/or activity of the gene, and/or its encoded protein by at least 2 fold, 3 fold, 4 fold, 6 fold, 8 fold or 9 fold.

In a specific embodiment, the invention provides methods and compositions for treating a CML patient exhibiting an aberrant up-regulation of a CML target gene as listed in Table 5a or 5b by reducing the expression and/or activity of the gene, and/or its encoded protein.

In another embodiment, the invention provides methods and compositions for treating a CML patient exhibiting an aberrant down-regulation of a CML target gene by enhancing the expression and/or activity of the gene, and/or its encoded protein by at least 2 fold, 3 fold, 4 fold, 6 fold, 8 fold or 9 fold.

In a specific embodiment, the invention provides methods and compositions for treating a CML patient exhibiting an aberrant down-regulation of a CML target gene as listed in Table 5a or 5b by enhancing the expression and/or activity of the gene, and/or its encoded protein.

In a specific embodiment, the invention provides a method for treating CML by administering to a patient (i) an agent that modulates the expression and/or activity of an imatinib resistance gene and/or the encoded protein, and (ii) a therapeutically sufficient amount of imatinib mesylate.

In another embodiment, the invention provides methods and compositions for treating a CML patient exhibiting aberrant regulation of a plurality of different CML target gene as listed in Tables 5a and 5b by modulating the expression and/or activity of the plurality of genes, and/or its encoded proteins. In one embodiment, a CML patient exhibiting aberrant up-regulation of a plurality of CML progression gene listed in Tables 5a and 5b, e.g. 2, 3, 4, 5, 10 or more different CML target genes, is treated by administering to the patient one or more agents that reduce the expression and/or activities of these genes, and/or their encoded proteins.

A variety of therapeutic approaches may be used in accordance with the invention to modulate expression of a CML target gene or imatinib resistance gene and/or its encoded protein in vivo. For example, siRNA molecules may be engineered and used to silence a CML target gene in vivo. Antisense DNA molecules may also be engineered and used to block translation of a CML target mRNA in vivo. Alternatively, ribozyme molecules may be designed to cleave and destroy the mRNAs of a CML target gene in vivo. In another alternative, oligonucleotides designed to hybridize to the 5' region of the CML target gene (including the region upstream of the coding sequence) and form triple helix structures may be used to block or reduce transcription of the CML target gene. The expression and/or activity of a CML target protein can be modulated using antibody, peptide or polypeptide molecules, and small organic or inorganic molecules. In the following, for simplicity, methods are described in reference to a CML target gene or protein. These methods are equally applicable to imatinib resistance genes.

In a preferred embodiment, RNAi is used to knock down the expression of a CML target gene. In one embodiment, double-stranded RNA molecules of 21-23 nucleotides which hybridize to a homologous region of mRNAs transcribed from the CML target gene are used to degrade the mRNAs, thereby "silence" the expression of the CML target gene. The method can be used to reduce expression levels of aberrantly up-regulated CML target genes. Preferably, the dsRNAs have a hybridizing region, e.g., a 19-nucleotide double-stranded region, which is complementary to a sequence of the coding sequence of the CML target gene. Any siRNA that targets an appropriate coding sequence of a CML target gene and exhibit a sufficient level of silencing can be used in the invention. As exemplary embodiments, 21-nucleotide double-stranded siRNAs targeting the coding regions of a CML target gene are designed according to selection rules known in the art (see, e.g., Elbashir et al., 2002, *Methods* 26:199-213; International Application No. PCT/US04/35636, filed Oct. 27, 2004, each of which is incorporated herein by reference in its entirety). In a preferred embodiment, the siRNA or siRNAs specifically inhibit the translation or transcription of a CML target protein without substantially affecting the translation or transcription of genes encoding other protein kinases in the same kinase family. In a specific embodiment, siRNAs targeting an up-regulated gene listed in Table 4 are used to silence the respective CML target genes.

The invention also provides methods and compositions for treating a CML patient exhibiting aberrant up-regulation of a plurality of CML target genes as listed in Tables 5a and 5b by reducing the expression and/or activities of these genes, and/or their encoded proteins. In one embodiment, a CML patient exhibiting aberrant up-regulation of a plurality of CML target gene listed in Tables 5a and 5b, e.g. 2, 3, 4, 5, 10 or more different CML target genes, is treated by administering to the patient one or more agents that reduce the expression and/or activities of these genes, and/or their encoded proteins. In a preferred embodiment, an siRNA is used to silence the plurality of different CML target genes. The sequence of the siRNA is chosen such that the transcript of each of the genes comprises a nucleotide sequence that is identical to a central contiguous nucleotide sequence of at least 11 nucleotides of the sense strand or the antisense strand of the siRNA, and/or comprises a nucleotide sequence that is identical to a contiguous nucleotide sequence of at least 9 nucleotides at the 3' end of the sense strand or the antisense strand of the siRNA. Thus, when administered to the patient, the siRNA silences all of the plurality of genes in cells of the patient. In preferred embodiments, the central contiguous nucleotide sequence of the siRNA that is identical to one or more CML target genes is 11-15, 14-15, 11, 12, or 13 nucleotides in length. In other preferred embodiments, the 3' contiguous nucleotide sequence of the siRNA that is identical to one or more CML target genes is 9-15, 9-12, 11, 10, or 9 nucleotides in length. The length and nucleotide base sequence of the target sequence of each different target gene, i.e., the sequence of the gene that is identical to an appropriate sense or antisense sequence of the siRNA, can be different from gene to gene. For example, gene A may have a sequence of 11 nucleotides identical to the nucleotide sequence 3-13 of the sense strand of the siRNA, while gene B may have a sequence of 12 nucleotides identical to the nucleotide sequence 4-15 of the sense strand of the siRNA. Thus, a single siRNA may be designed to silence a large number of CML target genes in cells.

RNAi can be carried out using any standard method for introducing nucleic acids into cells. In one embodiment, gene silencing is induced by presenting the cell with one or more siRNAs targeting the CML target gene (see, e.g., Elbashir et al., 2001, *Nature* 411, 494-498; Elbashir et al., 2001, *Genes Dev.* 15, 188-200, all of which are incorporated by reference herein in their entirety). The siRNAs can be chemically synthesized, or derived from cleavage of double-stranded RNA by recombinant Dicer. Another method to introduce a double stranded DNA (dsRNA) for silencing of the CML target gene is shRNA, for short hairpin RNA (see, e.g., Paddison et al., 2002, *Genes Dev.* 16, 948-958; Brummelkamp et al., 2002, *Science* 296, 550-553; Sui, G. et al. 2002, *Proc. Natl. Acad. Sci. USA* 99, 5515-5520, all of which are incorporated by reference herein in their entirety). In this method, a siRNA targeting a CML target gene is expressed from a plasmid (or virus) as an inverted repeat with an intervening loop sequence to form a hairpin structure. The resulting RNA transcript containing the hairpin is subsequently processed by Dicer to produce siRNAs for silencing. Plasmid- or virus-based shRNAs can be expressed stably in cells, allowing long-term gene silencing in cells both in vitro and in vivo (see, McCaffrey et al. 2002, *Nature* 418, 38-39; Xia et al., 2002, *Nat. Biotech.* 20, 1006-1010; Lewis et al., 2002, *Nat. Genetics* 32, 107-108; Rubinson et al., 2003, *Nat. Genetics* 33, 401-406; Tiscornia et al., 2003, *Proc. Natl. Acad. Sci. USA* 100, 1844-1848, all of which are incorporated by reference herein in their entirety). Such plasmid- or virus-based shRNAs can be delivered using a gene therapy approach. SiRNAs targeting the CML target gene can also be delivered to an organ or tissue in a mammal, such a human, in vivo (see, e.g., Song et al. 2003, *Nat. Medicine* 9, 347-351; Sorensen et al., 2003, *J Mol. Biol.* 327, 761-766; Lewis et al., 2002, *Nat. Genetics* 32, 107-108, all of which are incorporated by reference herein in their entirety). In this method, a solution of siRNA is injected intravenously into the mammal. The siRNA can then reach an organ or tissue of interest and effectively reduce the expression of the target gene in the organ or tissue of the mammal.

In preferred embodiments, an siRNA pool (mixture) containing at least k (k=2, 3, 4, 5, 6 or 10) different siRNAs targeting a CML target gene at different sequence regions is used to silence the gene. In a preferred embodiment, the total siRNA concentration of the pool is about the same as the concentration of a single siRNA when used individually. As used herein, the word "about" with reference to concentration means within 20%. Preferably, the total concentration of the pool of siRNAs is an optimal concentration for silencing the intended target gene. An optimal concentration is a concentration further increase of which does not increase the level of silencing substantially. In one embodiment, the optimal concentration is a concentration further increase of which does not increase the level of silencing by more than 5%, 10% or 20%. In a preferred embodiment, the composition of the pool, including the number of different siRNAs in the pool and the concentration of each different siRNA, is chosen such that the pool of siRNAs causes less than 30%, 20%, 10% or 5%, 1%, 0.1% or 0.01% of silencing of any off-target genes (e.g., as determined by standard nucleic acid assay, e.g., PCR). In another preferred embodiment, the concentration of each different siRNA in the pool of different siRNAs is about the same. In still another preferred embodiment, the respective concentrations of different siRNAs in the pool are different from each other by less than 5%, 10%, 20% or 50% of the concentration of any one siRNA or said total siRNA concentration of said different siRNAs. In still another preferred embodiment, at least one siRNA in the pool of different siRNAs constitutes more than 90%, 80%, 70%, 50%, or 20% of the total siRNA concentration in the pool. In still another preferred embodiment, none of the siRNAs in the pool of different siRNAs constitutes more than 90%, 80%, 70%, 50%, or 20% of the total siRNA concentration in the pool. In other embodiments, each siRNA in the pool has a concentration that is lower than the optimal concentration when used individually. In a preferred embodiment, each different siRNA in the pool has an concentration that is lower than the concentration of the siRNA that is effective to achieve at least 30%, 50%, 75%, 80%, 85%, 90% or 95% silencing when used in the absence of other siRNAs or in the absence of other siRNAs designed to silence the gene. In another preferred embodiment, each different siRNA in the pool has a concentration that causes less than 30%, 20%, 10% or 5% of silencing of the gene when used in the absence of other siRNAs or in in the absence of other siRNAs designed to silence the gene. In a preferred embodiment, each siRNA has a concentration that causes less than 30%, 20%, 10% or 5% of silencing of the target gene when used alone, while the plurality of siRNAs causes at least 80% or 90% of silencing of the target gene. In specific embodiments, a pool containing the 3 different is used for targeting a CML target gene. More detailed descriptions of techniques for carrying out RNAi are also presented in Section 5.6.

In other embodiments, antisense, ribozyme, and triple helix forming nucleic acid are designed to inhibit the translation or transcription of a CML target protein or gene with minimal effects on the expression of other genes that may share one or more sequence motif with the CML target gene. To accomplish this, the oligonucleotides used should be designed on the basis of relevant sequences unique to a CML target gene. In one embodiment, the oligonucleotide used specifically inhibits the translation or transcription of a CML target protein or gene without substantially affecting the translation or transcription of other proteins in the same protein family.

For example, and not by way of limitation, the oligonucleotides should not fall within those regions where the nucleotide sequence of a CML target gene is most homologous to that of other genes. In the case of antisense molecules, it is preferred that the sequence be at least 18 nucleotides in length in order to achieve sufficiently strong annealing to the target mRNA sequence to prevent translation of the sequence. Izant et al., 1984, Cell, 36:1007-1015; Rosenberg et al., 1985, Nature, 313:703-706.

Ribozymes are RNA molecules which possess highly specific endoribonuclease activity. Hammerhead ribozymes comprise a hybridizing region which is complementary in nucleotide sequence to at least part of the target RNA, and a catalytic region which is adapted to cleave the target RNA. The hybridizing region contains nine (9) or more nucleotides. Therefore, the hammerhead ribozymes useful for targeting a CML target gene having a hybridizing region which is complementary to the sequences of the target gene and is at least nine nucleotides in length. The construction and production of such ribozymes is well known in the art and is described more fully in Haseloff et al., 1988, Nature, 334: 585-591.

The ribozymes of the present invention also include RNA endoribonucleases (hereinafter "Cech-type ribozymes") such as the one which occurs naturally in Tetrahymena Thermophila (known as the IVS, or L-19 IVS RNA) and which has been extensively described by Thomas Cech and collaborators (Zaug, et al., 1984, Science, 224:574-578; Zaug and Cech, 1986, Science, 231:470-475; Zaug, et al., 1986, Nature, 324:429-433; published International patent application No. WO 88/04300 by University Patents Inc.; Been et al., 1986, Cell, 47:207-216). The Cech endoribonucleases have an eight base pair active site which hybridizes to a target RNA sequence whereafter cleavage of the target RNA takes place.

In the case of oligonucleotides that hybridize to and form triple helix structures at the 5' terminus of a CML target gene and can be used to block transcription, it is preferred that they be complementary to those sequences in the 5' terminus of a CML target gene which are not present in other related genes. It is also preferred that the sequences not include those regions of the promoter of a CML target gene which are even slightly homologous to that of other related genes.

The foregoing compounds can be administered by a variety of methods which are known in the art including, but not limited to the use of liposomes as a delivery vehicle. Naked DNA or RNA molecules may also be used where they are in a form which is resistant to degradation such as by modification of the ends, by the formation of circular molecules, or by the use of alternate bonds including phosphothionate and thiophosphoryl modified bonds. In addition, the delivery of nucleic acid may be by facilitated transport where the nucleic acid molecules are conjugated to poly-lysine or transferrin. Nucleic acid may also be transported into cells by any of the various viral carriers, including but not limited to, retrovirus, vaccinia, AAV, and adenovirus.

Alternatively, a recombinant nucleic acid molecule which encodes, or is, such antisense nucleic acid, ribozyme, triple helix forming nucleic acid, or nucleic acid molecule of a CML target gene can be constructed. This nucleic acid molecule may be either RNA or DNA. If the nucleic acid encodes an RNA, it is preferred that the sequence be operatively attached to a regulatory element so that sufficient copies of the desired RNA product are produced. The regulatory element may permit either constitutive or regulated transcription of the sequence. In vivo, that is, within the cells or cells of an organism, a transfer vector such as a bacterial plasmid or viral RNA or DNA, encoding one or more of the RNAs, may be transfected into cells e.g. (Llewellyn et al., 1987, J. Mol. Biol., 195:115-123; Hanahan et al. 1983, J. Mol. Biol., 166: 557-580). Once inside the cell, the transfer vector may replicate, and be transcribed by cellular polymerases to produce the RNA or it may be integrated into the genome of the host cell. Alternatively, a transfer vector containing sequences encoding one or more of the RNAs may be transfected into cells or introduced into cells by way of micromanipulation techniques such as microinjection, such that the transfer vector or a part thereof becomes integrated into the genome of the host cell.

The activity of a CML target protein can be modulated by modulating the interaction of a CML target protein with its binding partners. In one embodiment, agents, e.g., antibodies, peptides, aptamers, small organic or inorganic molecules, can be used to inhibit binding of a CML target protein binding partner to treat CML. In another embodiment, agents, e.g., antibodies, aptamers, small organic or inorganic molecules, can be used to inhibit the activity of a CML target protein to treat CML.

In other embodiments, when the CML target protein is a kinase, the invention provides small molecule inhibitors of the CML target protein. A small molecule inhibitor is a low molecular weight phosphorylation inhibitor. As used herein, a small molecule refers to an organic or inorganic molecule having a molecular weight is under 1000 Daltons, preferably in the range between 300 to 700 Daltons, which is not a nucleic acid molecule or a peptide molecule. The small molecule can be naturally occurring, e.g., extracted from plant or microorganisms, or non-naturally occurring, e.g., generated de novo by synthesis. A small molecule that is an inhibitor can be used to block a cellular process that dependent on a CML target protein. In one embodiment, the inhibitors are substrate Mimics. In a preferred embodiment, the inhibitor of the CML target proteins is an ATP mimic. In one embodiment, such ATP mimics possess at least two aromatic rings. In a preferred embodiment, the ATP mimic comprises a moiety that forms extensive contacts with residues lining the ATP binding cleft of the CML target protein and/or peptide segments just outside the cleft, thereby selectively blocking the ATP binding site of the CML target protein. Minor structural differences from ATP can be introduced into the ATP mimic based on the peptide segments just outside the cleft. Such differences can lead to specific hydrogen bonding and hydrophobic interactions with the peptide segments just outside the cleft.

In still other embodiments, antibodies that specifically bind the CML target protein are used. In a preferred embodiment, the invention provides antibodies that specifically bind the extracellular domain of a CML target protein that is a receptor. Antibodies that specifically bind a target can be obtained using standard method known in the art, e.g., a method described in Section 5.8.

In one embodiment, an antibody-drug conjugate comprising an antibody that specifically binds a CML target protein is used. The efficacy of the antibodies that targets specific molecules expressed by advanced phase immature myeloid cells can be increased by attaching toxins to them. Existing immunotoxins are based on bacterial toxins like pseudomonas exotoxin, plant exotoxin like ricin or radio-nucleotides. The toxins are chemically conjugated to a specific ligand such as the variable domain of the heavy or light chain of the monoclonal antibody. Normal cells lacking the cancer specific antigens are not targeted by the targeted antibody. In a preferred embodiment, the CML target protein target is PRAME.

In other embodiments, a peptide and peptidomimetic that interferes with the interaction of a CML target protein with its interaction partner is used. A peptide preferably has a size of at least 5, 10, 15, 20 or 30 amino acids. Such a peptide or peptidomimetic can be designed by a person skilled in the art based on the sequence and structure of a CML target protein. In one embodiment, a peptide or peptidomimetic that interferes with substrate binding of a CML target protein is used. In another embodiment, peptide or peptidomimetic that interferes with the binding of a signal molecule to a CML target protein is used. In some embodiments of the invention, a fragment or polypeptide of at least 5, 10, 20, 50, 100 amino acids in length of a CML target protein are used. In a specific embodiment, a peptide or peptidomimetic that interferes with the interaction with PRAME is used. The peptide can be prepared by standard method known in the art.

In another embodiment, a dominant negative mutant of a CML target protein is used to reduce activity of a CML target protein. Such a dominant negative mutant can be designed by a person skilled in the art based on the sequence and structure of a CML target protein. In one embodiment, a dominant negative mutant that interferes with substrate binding of a CML target protein is used. In another embodiment, a dominant negative mutant that interferes with the binding of a signal molecule to a CML target protein is used. In a preferred embodiment, the invention provides a dominant negative mutant that comprises the C-terminal region of a CML target protein. In another embodiment, the invention provides a dominant negative mutant that comprises the N-terminal region of the CML target protein.

Gene therapy can be used for delivering any of the above described nucleic acid and protein/peptide therapeutics into target cells. Gene therapy is particularly useful for enhancing aberrantly down-regulated genes. Exemplary methods for carrying out gene therapy are described below. For general reviews of the methods of gene therapy, see Goldspiel et al., 1993, Clinical Pharmacy 12:488-505; Wu and Wu, 1991, Biotherapy 3:87-95; Tolstoshev, 1993, Ann. Rev. Pharmacol. Toxicol. 32:573-596; Mulligan, 1993, Science 260:926-932; and Morgan and Anderson, 1993, Ann. Rev. Biochem. 62:191-217; May, 1993, TIBTECH 11 (5):155-215). Methods commonly known in the art of recombinant DNA technology which can be used are described in Ausubel et al. (eds.), 1993, Current Protocols in Molecular Biology, John Wiley & Sons, New York; and Kriegler, 1990, Gene Transfer and Expression, A Laboratory Manual, Stockton Press, New York.

In a preferred embodiment, the therapeutic comprises a nucleic acid that is part of an expression vector that expresses a the therapeutic nucleic acid or peptide/polypeptide in a suitable host. In particular, such a nucleic acid has a promoter operably linked to the coding region, said promoter being inducible or constitutive, and, optionally, tissue-specific. In another particular embodiment, a nucleic acid molecule is used in which the coding sequences and any other desired sequences are flanked by regions that promote homologous recombination at a desired site in the genome, thus providing for intrachromosomal expression of the CML target nucleic acid (see e.g., Koller and Smithies, 1989, Proc. Natl. Acad. Sci. U.S.A. 86:8932-8935; Zijlstra et al., 1989, Nature 342: 435-438).

Delivery of the nucleic acid into a patient may be either direct, in which case the patient is directly exposed to the nucleic acid or nucleic acid-carrying vector, or indirect, in which case, cells are first transformed with the nucleic acid in vitro, then transplanted into the patient. These two approaches are known, respectively, as in vivo or ex vivo gene therapy.

In a specific embodiment, the nucleic acid is directly administered in vivo, where it is expressed to produce the encoded product. This can be accomplished by any of numerous methods known in the art, e.g., by constructing it as part of an appropriate nucleic acid expression vector and administering it so that it becomes intracellular, e.g., by infection using a defective or attenuated retroviral or other viral vector (see U.S. Pat. No. 4,980,286), or by direct injection of naked DNA, or by use of microparticle bombardment (e.g., a gene gun; Biolistic, Dupont), or coating with lipids or cell-surface receptors or transfecting agents, encapsulation in liposomes, microparticles, or microcapsules, or by administering it in linkage to a peptide which is known to enter the nucleus, by administering it in linkage to a ligand subject to receptor-mediated endocytosis (see e.g., Wu and Wu, 1987, J. Biol. Chem. 262:4429-4432) (which can be used to target cell types specifically expressing the receptors), etc. In another embodiment, a nucleic acid-ligand complex can be formed in which the ligand comprises a fusogenic viral peptide to disrupt endosomes, allowing the nucleic acid to avoid lysosomal degradation. In yet another embodiment, the nucleic acid can be targeted in vivo for cell specific uptake and expression, by targeting a specific receptor (see, e.g., PCT Publications WO 92/06180 dated Apr. 16, 1992 (Wu et al.); WO 92/22635 dated Dec. 23, 1992 (Wilson et al.); WO92/20316 dated Nov. 26, 1992 (Findeis et al.); WO93/14188 dated Jul. 22, 1993 (Clarke et al.), WO 93/20221 dated Oct. 14, 1993 (Young)). Alternatively, the nucleic acid can be introduced intracellularly and incorporated within host cell DNA for expression, by homologous recombination (Koller and Smithies, 1989, Proc. Natl. Acad. Sci. U.S.A. 86:8932-8935; Zijlstra et al., 1989, Nature 342:435-438).

In a specific embodiment, a viral vector that contains the nucleic acid of a CML target gene is used. For example, a retroviral vector can be used (see Miller et al., 1993, Meth. Enzymol. 217:581-599). These retroviral vectors have been modified to delete retroviral sequences that are not necessary for packaging of the viral genome and integration into host cell DNA. The CML target nucleic acid to be used in gene therapy is cloned into the vector, which facilitates delivery of the gene into a patient. More detail about retroviral vectors can be found in Boesen et al., 1994, Biotherapy 6:291-302, which describes the use of a retroviral vector to deliver the mdrl gene to hematopoietic stem cells in order to make the stem cells more resistant to chemotherapy. Other references illustrating the use of retroviral vectors in gene therapy are: Clowes et al., 1994, J. Clin. Invest. 93:644-651; Kiem et al., 1994, Blood 83:1467-1473; Salmons and Gunzberg, 1993, Human Gene Therapy 4:129-141; and Grossman and Wilson, 1993, Curr. Opin. Genet. and Devel. 3:110-114.

Adenoviruses are other viral vectors that can be used in gene therapy. Adenoviruses are especially attractive vehicles for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson (1993, Current Opinion in Genetics and Development 3:499-503) present a review of adenovirus-based gene therapy. Bout et al. (1994, Human Gene Therapy 5:3-10) demonstrated the use of adenovirus vectors to transfer genes to the respiratory epithelia of rhesus monkeys. Other instances of the use of adenoviruses in gene therapy can be found in Rosenfeld et al., 1991, Science 252:431-434; Rosenfeld et al., 1992, Cell 68:143-155; and Mastrangeli et al., 1993, J. Clin. Invest. 91:225-234.

Adeno-associated virus (AAV) has also been proposed for use in gene therapy (Walsh et al., 1993, Proc. Soc. Exp. Biol. Med. 204:289-300).

Another approach to gene therapy involves transferring a gene to cells in tissue culture by such methods as electroporation, lipofection, calcium phosphate mediated transfection, or viral infection. Usually, the method of transfer includes the transfer of a selectable marker to the cells. The cells are then placed under selection to isolate those cells that have taken up and are expressing the transferred gene. Those cells are then delivered to a patient.

In this embodiment, the nucleic acid is introduced into a cell prior to administration in vivo of the resulting recombinant cell. Such introduction can be carried out by any method known in the art, including but not limited to transfection, electroporation, microinjection, infection with a viral or bacteriophage vector containing the nucleic acid sequences, cell fusion, chromosome-mediated gene transfer, microcell-mediated gene transfer, spheroplast fusion, etc. Numerous techniques are known in the art for the introduction of foreign genes into cells (see e.g., Loeffler and Behr, 1993, Meth. Enzymol. 217:599-618; Cohen et al., 1993, Meth. Enzymol. 217:618-644; Cline, 1985, Pharmac. Ther. 29:69-92) and may be used in accordance with the present invention, provided that the necessary developmental and physiological functions of the recipient cells are not disrupted. The technique should provide for the stable transfer of the nucleic acid to the cell, so that the nucleic acid is expressible by the cell and preferably heritable and expressible by its cell progeny.

The resulting recombinant cells can be delivered to a patient by various methods known in the art. In a preferred embodiment, epithelial cells are injected, e.g., subcutaneously. In another embodiment, recombinant skin cells may be applied as a skin graft onto the patient. Recombinant blood cells (e.g., hematopoietic stem or progenitor cells) are preferably administered intravenously. The amount of cells envisioned for use depends on the desired effect, patient state, etc., and can be determined by one skilled person in the art.

Cells into which a nucleic acid can be introduced for purposes of gene therapy encompass any desired, available cell type, and include but are not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., as obtained from bone marrow, umbilical cord blood, peripheral blood, fetal liver, etc.

In a preferred embodiment, the cell used for gene therapy is autologous to the patient.

In an embodiment in which recombinant cells are used in gene therapy, a nucleic acid is introduced into the cells such that it is expressible by the cells or their progeny, and the recombinant cells are then administered in vivo for therapeutic effect. In a specific embodiment, stem or progenitor cells are used. Such stem cells can be hematopoietic stem cells (HSC).

Any technique which provides for the isolation, propagation, and maintenance in vitro of HSC can be used in this embodiment of the invention. Techniques by which this may be accomplished include (a) the isolation and establishment of HSC cultures from bone marrow cells isolated from the future host, or a donor, or (b) the use of previously established long-term HSC cultures, which may be allogeneic or xenogeneic. Non-autologous HSC are used preferably in conjunction with a method of suppressing transplantation immune reactions of the future host/patient. In a particular embodiment of the present invention, human bone marrow cells can be obtained from the posterior iliac crest by needle aspiration (see e.g., Kodo et al., 1984, J. Clin. Invest. 73:1377-1384). The HSCs can be made highly enriched or in substantially pure form. This enrichment can be accomplished before, during, or after long-term culturing, and can be done by any techniques known in the art. Long-term cultures of bone marrow cells can be established and maintained by using, for example, modified Dexter cell culture techniques (Dexter et al., 1977, J. Cell Physiol. 91:335) or Witlock-Witte culture techniques (Witlock and Witte, 1982, Proc. Natl. Acad. Sci. U.S.A. 79:3608-3612).

In a specific embodiment, the nucleic acid to be introduced for purposes of gene therapy comprises an inducible promoter operably linked to the coding region, such that expression of the nucleic acid is controllable by controlling the presence or absence of the appropriate inducer of transcription.

The methods and/or compositions described above for modulating the expression and/or activity of a CML target gene or CML target protein may be used to treat patients in conjunction with a chemotherapeutic agent, e.g., Gleevec™.

The effects or benefits of administration of the compositions of the invention alone or in conjunction with a chemotherapeutic agent can be evaluated by any methods known in the art, e.g., by methods that are based on measuring the survival rate, side effects, dosage requirement of the chemotherapeutic agent, or any combinations thereof. If the administration of the compositions of the invention achieves any one or more benefits in a patient, such as increasing the survival rate, decreasing side effects, lowing the dosage requirement for the chemotherapeutic agent, the composi-

5.4. Diagnosis and Treatment of CML by Targeting Cell Surface Expressed PRAME The present invention provides methods and compositions for diagnosis and treatment of CML by targeting PRAME (GenBank® accession no. NM_006115) on cell surfaces of advanced phase hematopoetic stem cells and immature myeloid cells. PRAME is known to be expressed in testis and to expressed at a low level in endometrium, adrenals and ovaries, and is not expressed in other normal tissues. The inventors have found that PRAME is significantly overexpressed in advanced phase CML cells as compared to chronic phase CML cells. Thus, methods and compositions that target PRAME can be used for detecting advanced phase CML cells and for treating CML by selectively targeting advanced phase CML cells.

5.4.1. Methods of Detecting Advanced Phase CML

Antibodies or labeled antibodies directed against a PRAME (Preferentially Expressed Antigen of Melanoma) can be used for evaluating CML progression, e.g., by detecting the presence of PRAME protein on cell surface of hematopoetic stem cells and immature myeloid cells. Such diagnostic/prognostic methods are particularly useful for detecting CML progression in unsorted samples.

The tissue or cell type to be analyzed may include those which are known to relate to CML, e.g., bone marrow or peripheral blood. The protein isolation methods employed herein may, for example, be such as those described in Harlow and Lane (Harlow, E. and Lane, D., 1988, "Antibodies: A Laboratory Manual", Cold Spring Harbor Laboratory Press, Cold Spring Harbor, N.Y.), which is incorporated herein by reference in its entirety. The isolated cells can be derived from cell culture or from a patient. The analysis of cells taken from culture may be a necessary step in the assessment of cells to be used as part of a cell-based gene therapy technique or, alternatively, to test the effect of compounds for CML treatment.

In one embodiment, the invention provides a method for diagnosing whether a patient has advanced phase chronic myeloid leukemia (CML), comprising (a) contacting a cell sample from said patient with an antibody conjugate, said antibody conjugate comprising an antibody that binds a PRAME protein conjugated with a label; and (b) detecting said label in said sample, wherein detection of said label above a predetermined threshold indicating said patient has advanced phase CML. Detection of the labeled antibody can be performed using a method described in Section 5.2.5, supra.

5.4.2. Methods of Treating CML by Targeting PRAME

The invention provides methods and compositions for treating CML by targeting PRAME expressed on the cell surface.

In one embodiment, the present invention provides methods of using anti-PRAME antibodies for treatment of a CML patient. In the methods of the invention, one or more anti-PRAME antibodies are administered to the patient. The anti-PRAME antibodies bind to PRAME on the surface of advanced phase CML hematopoetic stem cells and/or immature myeloid cells. The binding of arti-PRAME antibodies to PRAME blocks the function mediated by PRAME, thereby preventing the proliferation of advanced phase hematopoetic stem cells.

In another embodiment, the present invention provides a method for treatment of CML using an anti-PRAME antibody that belongs to an isotype that is capable of mediating lysis of cells to which the anti-PRAME antibody is bound. In a preferred embodiment, the anti-PRAME antibody belongs to an isotype that binds a growth factor receptor and activates serum complement and/or mediates antibody dependent cellular cytotoxicity (ADCC) by activating effector cells, e.g., macrophages. In another preferred embodiment, the isotype is IgG1, IgG2a, IgG3 or IgM.

In still another embodiment, the anti-PRAME antibodies are used in conjunction with one or more other chemotherapeutic drugs. In such combined therapies, the anti-PRAME antibodies can be administered in a manner such as described in Section 5.10.5.

The dosage of the anti-PRAME antibodies can be determined by routine experiments that are familiar to one skilled in the art. The effects or benefits of administration of the anti-PRAME antibodies can be evaluated by any method known in the art.

In another embodiment, an antibody-drug conjugate comprising an antibody that specifically binds PRAME and a chemotherapeutic drug is used to selectively deliver the chemotherapeutic drug to advanced phase CML hematopoetic stem cells and/or immature myeloid cells. Chemotherapeutic drugs normally spread throughout the body, reaching not only the intended target but also healthy cells/organs such as the intestines and healthy bone marrow, where they kill off normal dividing cells. A drug conjugated to PRAME should be able to selectively target the advance phase CML hematopoetic stem cells and/or immature myeloid cells, thus increasing the sensitivity and specificity of the drug. For example, an anti-PRAME antibody may be conjugated to a therapeutic moiety such as a cytotoxin, e.g., a cytostatic or cytocidal agent, or a radioactive metal ion (see, e.g., Section 5.8). Any suitable antibody-drug conjugate, e.g., those described in Section 5.8.3 can be used. Normal hematopoetic stem cells and/or myeloid cells lack PRAME and are not targeted by the antibody.

In still another embodiment, a peptide or a peptidomimetic that interferes with the interaction of PRAME with its interaction partner is used. A peptide preferably has a size of at least 5, 10, 15, 20 or 30 amino acids. Such a peptide or peptidomimetic can be designed by a person skilled in the art based on the sequence and structure of PRAME. In some embodiments of the invention, a PRAME fragment of at least 5, 10, 20, 50, 100 amino acids in length is used. In a specific embodiment, a peptide or peptidomimetic that interferes with the interaction with PRAME is used. The peptide can be prepared by a standard method known in the art (see, e.g., Section 5.8.4).

The invention also provides methods for treating CML using fragments of a PRAME protein as vaccines to elicit an immunotherapeutic response in a patient, e.g., an antibody response and/or a cell mediated immune response. Antibody responses involve the production of antibodies, which are proteins called immunoglobulins. The antibodies circulate in the bloodstream and permeate the other body fluids, where they bind specifically to the foreign antigen that elicited them. Binding by antibody inactivates advanced phase CML hematopoetic stem cells and/or immature myeloid cells by blocking their functions facilitated by PRAME. Antibody binding also marks advanced phase CML hematopoetic stem cells and/or immature myeloid cells, either by making it easier for a phagocytic cell to ingest them or by activating a system of blood proteins, collectively called complement, which kills the marked target cells.

Cell-mediated immune responses to PRAME involve the production of specialized cells that react with PRAME antigen on the surface of advanced phase CML cells. T lymphocytes, which develop in the thymus, are responsible for cell-mediated immunity. The majority of T lymphocytes, called helper T cells and suppressor T cells, play a regulatory role in immunity, acting either to enhance or suppress the responses of other white blood cells. Other T lymphocytes, called cytotoxic T cells (CTLs), kill virus-infected cells, parasites, and cancer cells. The surface of T cells contains transmembrane proteins called T cell receptors that recognize the PRAME antigen on the surface of PRAME presenting advanced phase CML cells. T cell receptors are antibody-like proteins. The antigen must be presented to the T cell by a particular membrane protein, one encoded by a complex of genes called the major histocompatibility complex (MHC). Histocompatibility molecules are expressed on the cells of all higher vertebrates. There are two principal classes of MHC molecules, class I MHC and class II MHC. Cytotoxic T lymphocytes (CTLs) recognize foreign antigens in association with class I MHC glycoproteins on the surface of an antigen-presenting cell, whereas helper T cells recognize foreign antigens in association with class II MHC glycoproteins on the surface of an antigen-presenting cell. A cytotoxic T lymphocyte will kill an antigen-presenting cell when it recognizes antigen bound to class I MHC molecules on the surface of the antigen-presenting cell. In one embodiment, a PRAME vaccine is used to elicit production of CTLs.

The PRAME protein fragment or polypeptide can be prepared by a standard method known in the art. In a specific embodiment, the fragment is a human PRAME protein fragment, or its murine homolog. In another embodiment, the vaccine comprises a peptide sequence that is at least 30%, 50%, 70%, 90%, or 95% homologous (e.g., over an equal size) to such fragments of a PRAME protein, e.g., as determined by a BLAST algorithm. In some embodiments, the PRAME protein fragments or polypeptides are at least 5, 10, 20, 50, 100 amino acids in length.

A peptide or polypeptide which is functionally equivalent to any PRAME fragment described above can also be used. Such an equivalent PRAME fragment may contain deletions, additions or substitutions of amino acid residues within the amino acid sequence encoded by the PRAME gene sequence but which result in a silent change, thus producing a functionally equivalent PRAME protein fragment. Amino acid substitutions may be made on the basis of similarity in polarity, charge, solubility, hydrophobicity, hydrophilicity, and/or the amphipathic nature of the residues involved. Conservative substitutions may be made from among amino acids of the same polarity. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. "Functionally equivalent", as utilized herein, refers to a protein fragment capable of exhibiting a substantially similar in vivo activity as the endogenous PRAME protein fragment.

The PRAME peptide fragments may be produced by recombinant DNA technology using techniques well known in the art (see, e.g., Section 5.8.4).

The PRAME peptide can be used in combination with a suitable carrier and/or adjuvant, such as Freund's complete or incomplete adjuvant, or a similar immunostimulatory agent. An oil/surfactant based adjuvant comprising one or more surfactants combined with one or more non-metabolizable mineral oil or metabolizable oil, such as the Incomplete Seppic Adjuvant (Seppic, Paris, France), may be used. An Incomplete Seppic Adjuvant has a comparable effect as Incomplete Freund's Adjuvant for antibody production, but induces a lower inflammatory response.

A fragment of a PRAME gene can also be used as a DNA or RNA vaccine. In a specific embodiment, the fragment of a PRAME gene is a fragment of a human PRAME gene, or its murine homolog. The invention also provides any sequence that is at least 30%, 50%, 70%, 90%, or 95% homologous (e.g., over an equal size) to such fragments of a PRAME gene. In some embodiments of the invention, the fragment of a PRAME gene is at least 20, 25, 40, 60, 80, 100, 500, 1000 bases in length. Such sequences may be useful for production of PRAME peptides.

In another embodiment, the present invention provides a naked DNA or RNA vaccine comprising a fragment of a PRAME gene, and uses thereof. The PRAME DNA fragment can be administered as a vaccine to elicit anti-PRAME antibodies. The DNA can be converted to RNA for example by subcloning the DNA into a transcriptional vector, such as pGEM family of plasmid vectors, or under control of a transcriptional promoter of a virus such as vaccinia, and the RNA used as a naked RNA vaccine. The naked DNA or RNA vaccine can be injected alone, or combined with one or more DNA or RNA vaccines directed to PRAME.

The naked DNA or RNA vaccine of the present invention can be administered for example intramuscularly, or alternatively, can be used in nose drops. The DNA or RNA fragment or a portion thereof can be injected as naked DNA or RNA, as DNA or RNA encapsulated in liposomes, as DNA or RNA entrapped in proteoliposomes containing viral envelope receptor proteins (Nicolau, C. et al. Proc. Natl. Acad. Sci. U.S.A. 1983, 80, 1068; Kanoda, Y., et al. Science 1989, 243, 375; Mannino, R. J. et al. Biotechniques 1988, 6, 682). Alternatively, the DNA can be injected along with a carrier. A carrier can be a protein or such as a cytokine, for example interleukin 2, or a polylysine-glycoprotein carrier (Wu, G. Y. and Wu, C. H. J. Biol. Chem. 1988, 263, 14621), or a non-replicating vector, for example expression vectors containing either the Rous sarcoma virus or cytomegalovirus promoters. Such carrier proteins and vectors and methods for using same are known to a person in the art (See for example, Acsadi, G. et al. Nature 1991, 352, 815-818). In addition, the DNA or RNA could be coated onto tiny gold beads and the beads introduced into the skin with, for example, a gene gun (Cohen, J. Science 1993, 259, 1691-1692; Ulmer, J. B. et al. Science 1993, 259, 1745-1749).

5.4.3. Depletion of Advanced Phase CML Hematopoetic Stem Cells and/or Immature Myeloid Cells In Vitro The invention provides methods of depleting advanced phase CML hematopoetic stem cells and/or immature myeloid cells from bone marrow or blood in vitro (or ex vivo). In particular, the invention provides for methods of depleting advanced phase CML hematopoetic stem cells and/or immature myeloid cells by killing them or by separating them from bone marrow or blood. In one embodiment, anti-PRAME antibodies are combined, e.g., incubated, in vitro with bone marrow or blood from a patient, e.g., a human.

In one embodiment, a column containing an anti-PRAME antibody bound to a solid matrix is used to remove advanced phase hematopoetic stem cells and/or immature myeloid cells from a bone marrow or blood sample.

The anti-PRAME antibodies used in the in vitro depletion of advanced phase CML hematopoetic stem cells and/or immature myeloid cells from samples can be conjugated to detectable labels (e.g., various enzymes, fluorescent materials, luminescent materials, bioluminescent materials, and radioactive materials) or therapeutic agents (e.g., cytostatic and cytocidal agents), which are disclosed in section 5.8.3.

Anti-PRAME antibodies conjugated to detectable substances can be utilized to sort advanced phase hematopoetic stem cells and/or immature myeloid cells from bone marrow or peripheral blood samples by methods known to those of skill in the art. In one embodiment, advanced phase hematopoetic stem cells and/or immature myeloid cells are sorted using a fluorescence activated cell sorter (FACS). Fluorescence activated cell sorting (FACS) is a well-known method for separating particles, including cells, based on the fluorescent properties of the particles (Kamarch, 1987, Methods Enzymol, 151:150-165). Laser excitation of fluorescent moieties in the individual particles results in a small electrical charge allowing electromagnetic separation of positive and negative particles from a mixture.

In one embodiment, bone marrow or peripheral blood samples, obtained from a patient, e.g., a human, are incubated with fluorescently labeled PRAME specific antibodies for a time sufficient to allow the labeled antibodies to bind to the cells. In an alternative embodiment, such cells are incubated with PRAME specific antibodies, the cells are washed, and the cells are incubated with a second labeled antibody that recognizes the PRAME specific antibodies. In accordance with these embodiments, the cells are washed and processed through the cell sorter, allowing separation of cells that bind both antibodies to be separated from hybrid cells that do not bind both antibodies. FACS sorted particles may be directly deposited into individual wells of 96-well or 384-well plates to facilitate separation.

In another embodiment, magnetic beads can be used to separate advanced phase immature myeloid cells from bone marrow or peripheral blood samples. Advanced phase immature myeloid cells may be sorted using a magnetic activated cell sorting (MACS) technique, a method for separating particles based on their ability to bind magnetic beads (0.5-100 nm diameter) (Dynal, 1995). A variety of useful modifications can be performed on the magnetic microspheres, including covalent addition of antibody which immunospecifically recognizes PRAME. A magnetic field is then applied, to physically manipulate the selected beads. The beads are then mixed with the cells to allow binding. Cells are then passed through a magnetic field to separate out advanced phase CML hematopoetic stem cells and/or immature myeloid cells.

Bone marrow or peripheral blood sample from a patient that is depleted of advanced phase CML hematopoetic stem cells and/or immature myeloid cells can be used for autologous transplant treatment of the patient. Healthy bone marrow or peripheral blood cells from a sample depleted of advanced phase CML hematopoetic stem cells and/or immature myeloid cells can be collected. These cells can then be administered to the patient to replace the abnormal cells in the patient's bone marrow. Healthy bone marrow or peripheral blood cells can also be stored, e.g., frozen, for transplant at a later time.

5.5. Methods for Screening Agents That Modulate CML Progression/Target or IM Resistance Proteins Agents that modulate the expression or activity of a CML progression/target gene or encoded protein (or imatinib resistance gene or encoded protein), or modulate interaction of a CML progression/target protein (or imatinib resistance protein) with other proteins or molecules can be identified using a method described in this section. Such agents are useful in treating CML patients who exhibit aberrant regulation of these genes. In the following, for simplicity, methods directed to CML progression/target gene are described. These methods are equally applicable to imatinib resistance genes.

5.5.1. Screening Assays

The following assays are designed to identify compounds that bind to a CML progression gene or its products, bind to other cellular proteins that interact with a CML progression protein, bind to cellular constituents, e.g., proteins, that are affected by a CML progression protein, or bind to compounds that interfere with the interaction of the CML progression gene or its product with other cellular proteins and to compounds which modulate the expression or activity of a CML progression gene (i.e., modulate the expression level of the CML progression gene and/or modulate the activity level of the CML progression protein). Assays may additionally be utilized which identify compounds which bind to CML progression protein regulatory sequences (e.g., promoter sequences), see e.g., Platt, K. A., 1994, J. Biol. Chem. 269: 28558-28562, which is incorporated herein by reference in its entirety, which may modulate the level of CML progression gene expression. Compounds may include, but are not limited to, small organic molecules which are able to affect expression of the CML progression gene or some other gene involved in the CML progression protein pathways, or other cellular proteins. Further, among these compounds are compounds which affect the level of CML progression gene expression and/or CML progression protein activity and which can be used in the regulation of sensitivity to the effect of a chemotherapy agent.

Compounds may include, but are not limited to, peptides such as, for example, soluble peptides, including but not limited to, Ig-tailed fusion peptides, and members of random peptide libraries (see, e.g., Lam, K. S. et al., 1991, Nature 354:82-84; Houghten, R. et al., 1991, Nature 354:84-86), and combinatorial chemistry-derived molecular library made of D- and/or L-configuration amino acids, phosphopeptides (including, but not limited to members of random or partially degenerate, directed phosphopeptide libraries; see, e.g., Songyang, Z. et al., 1993, Cell 72:767-778), antibodies (including, but not limited to, polyclonal, monoclonal, humanized, anti-idiotypic, chimeric or single chain antibodies, and Fab, $F(ab')_2$ and Fab expression library fragments, and epitope-binding fragments thereof), and small organic or inorganic molecules.

Compounds identified via assays such as those described herein may be useful, for example, in modulating the biological function of the CML progression protein.

In vitro systems may be designed to identify compounds capable of binding a CML progression protein. Compounds identified may be useful, for example, in modulating the activity of wild type and/or mutant CML progression protein, may be useful in elaborating the biological function of the CML progression protein, may be utilized in screens for identifying compounds that disrupt normal CML progression protein interactions, or may in themselves disrupt such interactions.

The principle of the assays used to identify compounds that bind to the CML progression protein involves preparing a reaction mixture of the CML progression protein and the test compound under conditions and for a time sufficient to allow the two components to interact and bind, thus forming a complex which can be removed and/or detected in the reaction mixture. These assays can be conducted in a variety of ways. For example, one method to conduct such an assay would involve anchoring CML progression protein or the test substance onto a solid phase and detecting CML progression protein/test compound complexes anchored on the solid phase at the end of the reaction. In one embodiment of such a method, the CML progression protein may be anchored onto a solid surface, and the test compound, which is not anchored, may be labeled, either directly or indirectly.

In practice, microtiter plates may conveniently be utilized as the solid phase. The anchored component may be immobilized by non-covalent or covalent attachments. Non-covalent attachment may be accomplished by simply coating the solid surface with a solution of the protein and drying. Alternatively, an immobilized antibody, preferably a monoclonal antibody, specific for the protein to be immobilized may be used to anchor the protein to the solid surface. The surfaces may be prepared in advance and stored.

In order to conduct the assay, the nonimmobilized component is added to the coated surface containing the anchored component. After the reaction is complete, unreacted components are removed (e.g., by washing) under conditions such that any complexes formed will remain immobilized on the solid surface. The detection of complexes anchored on the solid surface can be accomplished in a number of ways. Where the previously nonimmobilized component is pre-labeled, the detection of label immobilized on the surface indicates that complexes were formed. Where the previously nonimmobilized component is not pre-labeled, an indirect label can be used to detect complexes anchored on the surface; e.g., using a labeled antibody specific for the previously nonimmobilized component (the antibody, in turn, may be directly labeled or indirectly labeled with a labeled anti-Ig antibody).

Alternatively, a reaction can be conducted in a liquid phase, the reaction products separated from unreacted components, and complexes detected; e.g., using an immobilized antibody specific for a CML progression protein or the test compound to anchor any complexes formed in solution, and a labeled antibody specific for the other component of the possible complex to detect anchored complexes.

The CML progression gene or CML progression protein may interact in vivo with one or more intracellular or extracellular molecules, such as proteins. For purposes of this discussion, such molecules are referred to herein as "binding partners". Compounds that disrupt CML progression protein binding may be useful in modulating the activity of the CML progression protein. Compounds that disrupt CML progression gene binding may be useful in modulating the expression of the CML progression gene, such as by modulating the binding of a regulator of CML progression gene. Such compounds may include, but are not limited to molecules such as peptides which would be capable of gaining access to the CML progression protein.

The basic principle of the assay systems used to identify compounds that interfere with the interaction between the CML progression protein and its intracellular or extracellular binding partner or partners involves preparing a reaction mixture containing the CML progression protein, and the binding partner under conditions and for a time sufficient to allow the two to interact and bind, thus forming a complex. In order to test a compound for inhibitory activity, the reaction mixture is prepared in the presence and absence of the test compound. The test compound may be initially included in the reaction mixture, or may be added at a time subsequent to the addition of a CML progression protein and its binding partner. Control reaction mixtures are incubated without the test compound or with a placebo. The formation of any complexes between the CML progression protein and the binding partner is then detected. The formation of a complex in the control reaction, but not in the reaction mixture containing the test compound, indicates that the compound interferes with the interaction of the CML progression protein and the interactive binding partner. Additionally, complex formation within reaction mixtures containing the test compound and a normal CML progression protein may also be compared to complex formation within reaction mixtures containing the test compound and a mutant CML progression protein. This comparison may be important in those cases where it is desirable to identify compounds that disrupt interactions of mutant but not the normal CML progression protein.

The assay for compounds that interfere with the interaction of the CML progression proteins and binding partners can be conducted in a heterogeneous or homogeneous format. Heterogeneous assays involve anchoring either the CML progression protein or the binding partner onto a solid phase and detecting complexes anchored on the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction between the CML progression proteins and the binding partners, e.g., by competition, can be identified by conducting the reaction in the presence of the test substance; i.e., by adding the test substance to the reaction mixture prior to or simultaneously with the CML progression protein and interactive binding partner. Alternatively, test compounds that disrupt preformed complexes, e.g. compounds with higher binding constants that displace one of the components from the complex, can be tested by adding the test compound to the reaction mixture after complexes have been formed. The various formats are described briefly below.

In a heterogeneous assay system, either the CML progression protein or its interactive binding partner, is anchored onto a solid surface, while the non-anchored species is labeled, either directly or indirectly. In practice, microtiter plates are conveniently utilized. The anchored species may be immobilized by non-covalent or covalent attachments. Non-covalent attachment may be accomplished simply by coating the solid surface with a solution of the CML progression protein or binding partner and drying. Alternatively, an immobilized antibody specific for the species to be anchored may be used to anchor the species to the solid surface. The surfaces may be prepared in advance and stored.

In order to conduct the assay, the partner of the immobilized species is exposed to the coated surface with or without the test compound. After the reaction is complete, unreacted components are removed (e.g., by washing) and any complexes formed will remain immobilized on the solid surface. The detection of complexes anchored on the solid surface can be accomplished in a number of ways. Where the non-immobilized species is pre-labeled, the detection of label immobilized on the surface indicates that complexes were formed. Where the non-immobilized species is not pre-labeled, an indirect label can be used to detect complexes anchored on the surface; e.g., using a labeled antibody specific for the initially non-immobilized species (the antibody, in turn, may be directly labeled or indirectly labeled with a labeled anti-Ig antibody). Depending upon the order of addition of reaction components, test compounds which inhibit complex formation or which disrupt preformed complexes can be detected.

Alternatively, the reaction can be conducted in a liquid phase in the presence or absence of the test compound, the reaction products separated from unreacted components, and complexes detected; e.g., using an immobilized antibody specific for one of the binding components to anchor any complexes formed in solution, and a labeled antibody specific for the other partner to detect anchored complexes. Again, depending upon the order of addition of reactants to the liquid phase, test compounds which inhibit complex or which disrupt preformed complexes can be identified.

In an alternative embodiment of the invention, a homogeneous assay can be used. In this approach, a preformed complex of the CML progression protein and the interactive binding partner is prepared in which either the CML progression protein or its binding partners is labeled, but the signal generated by the label is quenched due to complex formation (see, e.g., U.S. Pat. No. 4,109,496 which utilizes this approach for immunoassays). The addition of a test substance that competes with and displaces one of the species from the preformed complex will result in the generation of a signal above background. In this way, test substances which disrupt CML progression protein/binding partner interaction can be identified.

In a particular embodiment, the CML progression protein can be prepared for immobilization using recombinant DNA techniques. For example, the coding region of CML progression gene can be fused to a glutathione-S-transferase (GST) gene using a fusion vector, such as pGEX-5X-1, in such a manner that its binding activity is maintained in the resulting fusion protein. The interactive binding partner can be purified and used to raise a monoclonal antibody, using methods routinely practiced in the art. This antibody can be labeled with the radioactive isotope $^{125}$I, for example, by methods routinely practiced in the art. In a heterogeneous assay, e.g., the GST-CML progression protein fusion protein can be anchored to glutathione-agarose beads. The interactive binding partner can then be added in the presence or absence of the test compound in a manner that allows interaction and binding to occur. At the end of the reaction-period, unbound material can be washed away, and the labeled monoclonal antibody can be added to the system and allowed to bind to the complexed components. The interaction between the CML progression protein and the interactive binding partner can be detected by measuring the amount of radioactivity that remains associated with the glutathione-agarose beads. A successful inhibition of the interaction by the test compound will result in a decrease in measured radioactivity.

Alternatively, the GST-CML progression protein fusion protein and the interactive binding partner can be mixed together in liquid in the absence of the solid glutathione-agarose beads. The test compound can be added either during or after the species are allowed to interact. This mixture can then be added to the glutathione-agarose beads and unbound material is washed away. Again the extent of inhibition of the CML progression protein/binding partner interaction can be detected by adding the labeled antibody and measuring the radioactivity associated with the beads.

In another embodiment of the invention, these same techniques can be employed using peptide fragments that correspond to the binding domains of the CML progression protein and/or the interactive binding partner (in cases where the binding partner is a protein), in place of one or both of the full length proteins. Any number of methods routinely practiced in the art can be used to identify and isolate the binding sites. These methods include, but are not limited to, mutagenesis of the gene encoding one of the proteins and screening for disruption of binding in a co-immunoprecipitation assay. Compensating mutations in the gene encoding the second species in the complex can then be selected. Sequence analysis of the genes encoding the respective proteins will reveal the mutations that correspond to the region of the protein involved in interactive binding. Alternatively, one protein can be anchored to a solid surface using methods described in this section above, and allowed to interact with and bind to its labeled binding partner, which has been treated with a proteolytic enzyme, such as trypsin. After washing, a short, labeled peptide comprising the binding domain may remain associated with the solid material, which can be isolated and identified by amino acid sequencing. Also, once the gene coding for the binding partner is obtained, short gene segments can be engineered to express peptide fragments of the protein, which can then be tested for binding activity and purified or synthesized.

For example, and not by way of limitation, a CML progression protein can be anchored to a solid material as described in this section, above, by making a GST-CML progression protein fusion protein and allowing it to bind to glutathione agarose beads. The interactive binding partner can be labeled with a radioactive isotope, such as $^{35}$S, and cleaved with a proteolytic enzyme such as trypsin. Cleavage products can then be added to the anchored GST-CML progression protein fusion protein and allowed to bind. After washing away unbound peptides, labeled bound material, representing the binding partner binding domain, can be eluted, purified, and analyzed for amino acid sequence by well-known methods. Peptides so identified can be produced synthetically or fused to appropriate facilitative proteins using recombinant DNA technology.

Some CML progression proteins are kinases. Kinase activity of a CML progression protein can be assayed in vitro using a synthetic peptide substrate of a CML progression protein of interest, e.g., a GSK-derived biotinylated peptide substrate. The phosphopeptide product is quantitated using a Homogenous Time-Resolved Fluorescence (HTRF) assay system (Park et al., 1999, *Anal. Biochem.* 269:94-104). The reaction mixture contains suitable amounts of ATP, peptide substrate, and the CML progression protein. The peptide substrate has a suitable amino acid sequence and is biotinylated at the N-terminus. The kinase reaction is incubated, and then terminated with Stop/Detection Buffer and GSK3α anti-phosphoserine antibody (e.g., Cell Signaling Technologies, Beverly, Mass.; Cat# 9338) labeled with europium-chelate (e.g., from Perkin Elmer, Boston, Mass.). The reaction is allowed to equilibrate, and relative fluorescent units are determined. Inhibitor compounds are assayed in the reaction described above, to determine compound IC50s. A particular compound is added to in a half-log dilution series covering a suitable range of concentrations, e.g., from 1 nM to 100 μM. Relative phospho substrate formation, read as HTRF fluorescence units, is measured over the range of compound concentrations and a titration curve generated using a four parameter sigmoidal fit. Specific compounds having $IC_{50}$ below a predetermined threshold value, e.g., ≦50 μM against a substrate, can be identified.

The extent of peptide phosphorylation can be determined by Homogeneous Time Resolved Fluorescence (HTRF) using a lanthanide chelate (Lance)-coupled monoclonal antibody specific for the phosphopeptide in combination with a streptavidin-linked allophycocyanin (SA-APC) fluorophore which binds to the biotin moiety on the peptide. When the Lance and APC are in proximity (i.e. bound to the same phosphopeptide molecule), a non-radiative energy transfer takes place from the Lance to the APC, followed by emission of light from APC at 665 nm. The assay can be run using various assay format, e.g., streptavidin flash plate assay, streptavidin filter plate assay.

A standard PKA assay can be used to assay the activity of protein kinase A (PKA). A standard PKC assay can be used to assay the activity of protein kinase C (PKC). The most common methods for assaying PKA or PKC activity involves measuring the transfer of $^{32}$P-labeled phosphate to a protein or peptide substrate that can be captured on phosphocellulose filters via weak electrostatic interactions.

Kinase inhibitors can be identified using fluorescence polarization to monitor kinase activity. This assay utilizes GST-CML progression protein, peptide substrate, peptide substrate tracer, an anti-phospho monoclonal IgG, and the inhibitor compound. Reactions are incubated for a period of time and then terminated. Stopped reactions are incubated and fluorescence polarization values determined.

In a specific embodiment, a standard SPA Filtration Assay and FlashPlate® Kinase Assay can be used to measure the activity of a CML progression protein. In these assays, GST-CML progression protein, biotinylated peptide substrate, ATP, and $^{33}$P-γ-ATP are allowed to react. After a suitable period of incubation, the reactions are terminated. In a SPA Filtration Assay, peptide substrate is allowed to bind Scintilation proximity assay (SPA) beads (Amersham Biosciences), followed by filtration on a Packard GF/B Unifilter plate and washed with phosphate buffered saline. Dried plates are sealed and the amount of $^{33}$P incorporated into the peptide substrate is determined. In a FlashPlate® Kinase Assay, a suitable amount of the reaction is transferred to streptavidin-coated FlashPlates® (NEN) and incubated. Plates are washed, dried, sealed and the amount of $^{33}$P incorporated into the peptide substrate is determined.

A standard DELFIA® Kinase Assay can also be used. In a DELFIA® Kinase Assay, GST-CML progression protein, peptide substrate, and ATP are allowed to react. After the reactions are terminated, the biotin-peptide substrates are captured in the stopped reactions. Wells are washed and reacted with anti-phospho polyclonal antibody and europium labeled anti-rabbit-IgG. Wells are washed and europium released from the bound antibody is detected.

Other assays, such as those described in WO 04/080973, WO 02/070494, and WO 03/101444, may also be utilized to determine biological activity of the instant compounds.

5.5.2. Screening Compounds that Modulate Expression or Activity of a Gene and/or its Products For CML progression genes that are kinases, inhibitor compounds can be assayed for their ability to inhibit a CML progression protein in hematopoetic stem cells and/or immature myeloid cells by monitoring the phosphorylation or autophosphorylation in response to the compound. Cells are grown in culture medium. Cells are pooled, counted, seeded into 6 well dishes at 200,000 cells per well in 2 ml media, and incubated. Serial dilution series of compounds or control are added to each well and incubated. Following the incubation period, each well is washed and Protease Inhibitor Cocktail Complete is added to each well. Lysates are then transferred to microcentrifuge tubes and frozen at −80° C. Lysates are thawed on ice and cleared by centrifugation and the supernatants are transferred to clean tubes. Samples are electorphoresed and proteins are transferred onto PVDF. Blots are then blocked and probed using an antibody against phospho-serine or phospho threonine. Bound antibody is visualized using a horseradish peroxidase conjugated secondary antibody and enhanced chemiluminescence. After stripping of the first antibody set, blots are re-probed for total CML progression protein, using a monoclonal antibody specific for the CML progression protein. The CML progression protein monoclonal is detected using a sheep anti-mouse IgG coupled to horseradish peroxidase and enhanced chemiluminescence. ECL exposed films are scanned and the intensity of specific bands is quantitated. Titrations are evaluated for level of phosphor-Ser signal normalized to total CML progression protein and IC50 values are calculated.

Detection of phosphonucleolin in cell lysates can be carried out using biotinylated anti-nucleolin antibody and ruthenylated goat anti-mouse antibody. To each well of a 96-well plate is added biotynylated anti-nucleolin antibody and streptavidin coated paramagnetic beads, along with a suitable cell lysate. The antibodies and lysate are incubated. Next, another anti-phosphonucleolin antibody are added to each well of the lysate mix and incubated. Lastly, the ruthenylated goat anti-mouse antibody in antibody buffer is added to each well and incubated. The lysate antibody mixtures are read and EC50s for compound dependent increases in phosphor-nucleolin are determined.

The compounds identified in the screen include compounds that demonstrate the ability to selectively modulate the expression or activity of a CML progression gene or its encoded protein. These compounds include but are not limited to siRNA, antisense nucleic acid, ribozyme, triple helix forming nucleic acid, antibody, and polypeptide molecules, aptamrs, and small organic or inorganic molecules.

5.6. Methods of Performing RNA Interference

Any method known in the art for gene silencing can be used in the present invention (see, e.g., Guo et al., 1995, Cell 81:611-620; Fire et al., 1998, Nature 391:806-811; Grant, 1999, Cell 96:303-306; Tabara et al., 1999, Cell 99:123-132; Zamore et al., 2000, Cell 101:25-33; Bass, 2000, Cell 101: 235-238; Petcherski et al., 2000, Nature 405:364-368; Elbashir et al., Nature 411:494-498; Paddison et al., Proc. Natl. Acad. Sci. USA 99:1443-1448). The siRNAs targeting a gene can be designed according to methods known in the art (see, e.g., International Application Publication No. WO 2005/018534, published on Mar. 3, 2005, and Elbashir et al., 2002, *Methods* 26:199-213, each of which is incorporated herein by reference in its entirety).

An siRNA having only partial sequence homology to a target gene can also be used (see, e.g., International Application Publication No. WO 2005/018534, published on Mar. 3, 2005, which is incorporated herein by reference in its entirety). In one embodiment, an siRNA that comprises a sense strand contiguous nucleotide sequence of 11-18 nucleotides that is identical to a sequence of a transcript of a gene but the siRNA does not have full length homology to any sequences in the transcript is used to silence the gene. Preferably, the contiguous nucleotide sequence is in the central region of the siRNA molecules. A contiguous nucleotide sequence in the central region of an siRNA can be any continuous stretch of nucleotide sequence in the siRNA which does not begin at the 3' end. For example, a contiguous nucleotide sequence of 11 nucleotides can be the nucleotide sequence 2-12, 3-13, 4-14, 5-15, 6-16, 7-17, 8-18, or 9-19. In preferred embodiments, the contiguous nucleotide sequence is 11-16, 11-15, 14-15, 11, 12, or 13 nucleotides in length.

In another embodiment, an siRNA that comprises a 3' sense strand contiguous nucleotide sequence of 9-18 nucleotides which is identical to a sequence of a transcript of a gene but which siRNA does not have full length sequence identity to any contiguous sequences in the transcript is used to silence the gene. In this application, a 3' 9-18 nucleotide sequence is a continuous stretch of nucleotides that begins at the first paired base, i.e., it does not comprise the two base 3' overhang. Thus, when it is stated that a particular nucleotide sequence is at the 3' end of the siRNA, the 2 base overhang is not considered. In preferred embodiments, the contiguous nucleotide sequence is 9-16, 9-15, 9-12, 11, 10, or 9 nucleotides in length.

An siRNA having only partial sequence homology to its target genes is especially useful for silencing a plurality of different genes in a cell. In one embodiment, an siRNA is used to silence a plurality of different genes, the transcript of each of the genes comprises a nucleotide sequence that is identical to a central contiguous nucleotide sequence of at least 11 nucleotides of the sense strand or the antisense strand of the siRNA, and/or comprises a nucleotide sequence that is identical to a contiguous nucleotide sequence of at least 9 nucleotides at the 3' end of the sense strand or the antisense strand of the siRNA. In preferred embodiments, the central contiguous nucleotide sequence is 11-15, 14-15, 11, 12, or 13 nucleotides in length. In other preferred embodiments, the 3' contiguous nucleotide sequence is 9-15, 9-12, 11, 10, or 9 nucleotides in length.

In one embodiment, in vitro siRNA transfection is carried out as follows: one day prior to transfection, 100 microliters of chosen cells, e.g., cervical cancer HeLa cells (ATCC, Cat. No. CCL-2), grown in DMEM/10% fetal bovine serum (Invitrogen, Carlsbad, Calif.) to approximately 90% confluency are seeded in a 96-well tissue culture plate (Corning, Corning, N.Y.) at 1500 cells/well. For each transfection 85 microliters of OptiMEM (Invitrogen) is mixed with 5 microliter of serially diluted siRNA (Dharna on, Denver) from a 20 micro molar stock. For each transfection 5 microliter OptiMEM is mixed with 5 microliter Oligofectamine reagent (Invitrogen) and incubated 5 minutes at room temperature. The 10 microliter OptiMEM/Oligofectamine mixture is dispensed into each tube with the OptiMEM/siRNA mixture, mixed and incubated 15-20 minutes at room temperature. 10 microliter of the transfection mixture is aliquoted into each well of the 96-well plate and incubated for 4 hours at 37° C. and 5% $CO_2$.

In preferred embodiments, an siRNA pool containing at least k (k=2, 3, 4, 5, 6 or 10) different siRNAs targeting the secondary target gene at different sequence regions is used to transfect the cells. In another preferred embodiment, an siRNA pool containing at least k (k=2, 3, 4, 5, 6 or 10) different siRNAs targeting two or more different target genes is used to transfect the cells.

In a preferred embodiment, the total siRNA concentration of the pool is about the same as the concentration of a single siRNA when used individually, e.g., 100 nM. Preferably, the total concentration of the pool of siRNAs is an optimal concentration for silencing the intended target gene. An optimal concentration is a concentration further increase of which does not increase the level of silencing substantially. In one embodiment, the optimal concentration is a concentration further increase of which does not increase the level of silencing by more than 5%, 10% or 20%. In a preferred embodiment, the composition of the pool, including the number of different siRNAs in the pool and the concentration of each different siRNA, is chosen such that the pool of siRNAs causes less than 30%, 20%, 10% or 5%, 1%, 0.1% or 0.01% of silencing of any off-target genes (e.g., as determined by standard nucleic acid assay, e.g., PCR). In another preferred embodiment, the concentration of each different siRNA in the pool of different siRNAs is about the same. In still another preferred embodiment, the respective concentrations of different siRNAs in the pool are different from each other by less than 5%, 10%, 20% or 50% of the concentration of any one siRNA or said total siRNA concentration of said different siRNAs. In still another preferred embodiment, at least one siRNA in the pool of different siRNAs constitutes more than 90%, 80%, 70%, 50%, or 20% of the total siRNA concentration in the pool. In still another preferred embodiment, none of the siRNAs in the pool of different siRNAs constitutes more than 90%, 80%, 70%, 50%, or 20% of the total siRNA concentration in the pool. In other embodiments, each siRNA in the pool has an concentration that is lower than the optimal concentration when used individually. In a preferred embodiment, each different siRNA in the pool has an concentration that is lower than the concentration of the siRNA that is effective to achieve at least 30%, 50%, 75%, 80%, 85%, 90% or 95% silencing when used in the absence of other siRNAs or in the absence of other siRNAs designed to silence the gene. In another preferred embodiment, each different siRNA in the pool has a concentration that causes less than 30%, 20%, 10% or 5% of silencing of the gene when used in the absence of other siRNAs or in the absence of other siRNAs designed to silence the gene. In a preferred embodiment, each siRNA has a concentration that causes less than 30%, 20%, 10% or 5% of silencing of the target gene when used alone, while the plurality of siRNAs causes at least 80% or 90% of silencing of the target gene.

Another method for gene silencing is to introduce an shRNA, for short hairpin RNA (see, e.g., Paddison et al., 2002, Genes Dev. 16, 948-958; Brummelkamp et al., 2002, Science 296, 550-553; Sui, G. et al. 2002, Proc. Natl. Acad. Sci. USA 99, 5515-5520, all of which are incorporated by reference herein in their entirety), which can be processed in the cells into siRNA. In this method, a desired siRNA sequence is expressed from a plasmid (or virus) as an inverted repeat with an intervening loop sequence to form a hairpin structure. The resulting RNA transcript containing the hairpin is subsequently processed by Dicer to produce siRNAs for silencing. Plasmid-based shRNAs can be expressed stably in cells, allowing long-term gene silencing in cells both in vitro and in vivo, e.g., in animals (see, McCaffrey et al. 2002, Nature 418, 38-39; Xia et al., 2002, Nat. Biotech. 20, 1006-1010; Lewis et al., 2002, Nat. Genetics 32, 107-108; Rubinson et al., 2003, Nat. Genetics 33, 401-406; Tiscornia et al., 2003, Proc. Natl. Acad. Sci. USA 100, 1844-1848, all of which are incorporated by reference herein in their entirety). Thus, in one embodiment, a plasmid-based shRNA is used.

In a preferred embodiment, shRNAs are expressed from recombinant vectors introduced either transiently or stably integrated into the genome (see, e.g., Paddison et al., 2002, Genes Dev 16:948-958; Sui et al., 2002, Proc Natl Acad Sci USA 99:5515-5520; Yu et al., 2002, Proc Natl Acad Sci USA 99:6047-6052; Miyagishi et al., 2002, Nat Biotechnol 20:497-500; Paul et al., 2002, Nat Biotechnol 20:505-508; Kwak et al., 2003, J Pharmacol Sci 93:214-217; Brummelkamp et al., 2002, Science 296:550-553; Boden et al., 2003, Nucleic Acids Res 31:5033-5038; Kawasaki et al., 2003, Nucleic Acids Res 31:700-707). The siRNA that disrupts the target gene can be expressed (via an shRNA) by any suitable vector which encodes the shRNA. The vector can also encode a marker which can be used for selecting clones in which the vector or a sufficient portion thereof is integrated in the host genome such that the shRNA is expressed. Any standard method known in the art can be used to deliver the vector into the cells. In one embodiment, cells expressing the shRNA are generated by transfecting suitable cells with a plasmid containing the vector. Cells can then be selected by the appropriate marker. Clones are then picked, and tested for knockdown. In a preferred embodiment, the expression of the shRNA is under the control of an inducible promoter such that the silencing of its target gene can be turned on when desired. Inducible expression of an siRNA is particularly useful for targeting essential genes.

In one embodiment, the expression of the shRNA is under the control of a regulated promoter that allows tuning of the silencing level of the target gene. This allows screening against cells in which the target gene is partially knocked out. As used herein, a "regulated promoter" refers to a promoter that can be activated when an appropriate inducing agent is present. An "inducing agent" can be any molecule that can be used to activate transcription by activating the regulated promoter. An inducing agent can be, but is not limited to, a peptide or polypeptide, a hormone, or an organic small molecule. An analogue of an inducing agent, i.e., a molecule that activates the regulated promoter as the inducing agent does, can also be used. The level of activity of the regulated promoter induced by different analogues may be different, thus allowing more flexibility in tuning the activity level of the regulated promoter. The regulated promoter in the vector can be any mammalian transcription regulation system known in the art (see, e.g., Gossen et al, 1995, Science 268:1766-1769; Lucas et al, 1992, Annu. Rev. Biochem. 61:1131; Li et al., 1996, Cell 85:319-329; Saez et al., 2000, Proc. Natl. Acad. Sci. USA 97:14512-14517; and Pollock et al., 2000, Proc. Nati. Acad. Sci. USA 97:13221-13226). In preferred embodiments, the regulated promoter is regulated in a dosage and/or analogue dependent manner. In one embodiment, the level of activity of the regulated promoter is tuned to a desired level by a method comprising adjusting the concentration of the inducing agent to which the regulated promoter is responsive. The desired level of activity of the regulated promoter, as obtained by applying a particular concentration of the inducing agent, can be determined based on the desired silencing level of the target gene.

In one embodiment, a tetracycline regulated gene expression system is used (see, e.g., Gossen et al, 1995, Science 268:1766-1769; U.S. Pat. No. 6,004,941). A tet regulated system utilizes components of the tet repressor/operator/inducer system of prokaryotes to regulate gene expression in eukaryotic cells. Thus, the invention provides methods for using the tet regulatory system for regulating the expression of an shRNA linked to one or more tet operator sequences. The methods involve introducing into a cell a vector encoding a fusion protein that activates transcription. The fusion protein comprises a first polypeptide that binds to a tet operator sequence in the presence of tetracycline or a tetracycline analogue operatively linked to a second polypeptide that activates transcription in cells. By modulating the concentration of a tetracycline, or a tetracycline analogue, expression of the tet operator-linked shRNA is regulated.

In other embodiments, an ecdyson regulated gene expression system (see, e.g., Saez et al., 2000, Proc. Natl. Acad. Sci. USA 97:14512-14517), or an MMTV glucocorticoid response element regulated gene expression system (see, e.g., Lucas et al, 1992, Annu. Rev. Biochem. 61:1131) may be used to regulate the expression of the shRNA.

In one embodiment, the pRETRO-SUPER (pRS) vector which encodes a puromycin-resistance marker and drives shRNA expression from an HI (RNA Pol III) promoter is used. The pRS-shRNA plasmid can be generated by any standard method known in the art. In one embodiment, the pRS-shRNA is deconvoluted from the library plasmid pool for a chosen gene by transforming bacteria with the pool and looking for clones containing only the plasmid of interest. Preferably, a 19mer siRNA sequence is used along with suitable forward and reverse primers for sequence specific PCR. Plasmids are identified by sequence specific PCR, and confirmed by sequencing. Cells expressing the shRNA are generated by transfecting suitable cells with the pRS-shRNA plasmid. Cells are selected by the appropriate marker, e.g., puromycin, and maintained until colonies are evident. Clones are then picked, and tested for knockdown. In another embodiment, an shRNA is expressed by a plasmid, e.g., a pRS-shRNA. The knockdown by the pRS-shRNA plasmid, can be achieved by transfecting cells using Lipofectamine 2000 (Invitrogen).

In yet another method, siRNAs can be delivered to an organ or tissue in an animal, such a human, in vivo (see, e.g., Song et al. 2003, Nat. Medicine 9, 347-351; Sorensen et al., 2003, J Mol. Biol. 327, 761-766; Lewis et al., 2002, Nat. Genetics 32, 107-108, all of which are incorporated by reference herein in their entirety). In this method, a solution of siRNA is injected intravenously into the animal. The siRNA can then reach an organ or tissue of interest and effectively reduce the expression of the target gene in the organ or tissue of the animal.

5.7. Production of CML Progression/Target or IM Resistance Proteins and Peptides CML progression proteins, or peptide fragments thereof, can be prepared for uses according to the present invention. For example, CML progression proteins, or peptide fragments thereof, can be used for the generation of antibodies, in diagnostic assays, for screening of inhibitors, or for the identification of other cellular gene products involved in the regulation of expression and/or activity of a CML progression gene.

The CML progression proteins or peptide fragments thereof, may be produced by recombinant DNA technology using techniques well known in the art. The amino acid sequences of the CML progression proteins are well-known and can be obtained from, e.g., GenBank®. Methods which are well known to those skilled in the art can be used to construct expression vectors containing CML progression protein coding sequences and appropriate transcriptional and translational control signals. These methods include, for example, in vitro recombinant DNA techniques, synthetic techniques, and in vivo genetic recombination. See, for example, the techniques described in Sambrook et al., 1989, supra, and Ausubel et al., 1989, supra. Alternatively, RNA capable of encoding CML progression protein sequences may be chemically synthesized using, for example, synthesizers. See, for example, the techniques described in "Oligonucleotide Synthesis", 1984, Gait, M. J. ed., IRL Press, Oxford, which is incorporated herein by reference in its entirety.

A variety of host-expression vector systems may be utilized to express the CML progression gene coding sequences. Such host-expression systems represent vehicles by which the coding sequences of interest may be produced and subsequently purified, but also represent cells which may, when transformed or transfected with the appropriate nucleotide coding sequences, exhibit the CML progression protein in situ. These include but are not limited to microorganisms such as bacteria (e.g., *E. coli, B. subtilis*) transformed with recombinant bacteriophage DNA, plasmid DNA or cosmid DNA expression vectors containing CML progression protein coding sequences; yeast (e.g., *Saccharomyces, Pichia*) transformed with recombinant yeast expression vectors containing the CML progression protein coding sequences; insect cell systems infected with recombinant virus expression vectors (e.g., baculovirus) containing the CML progression protein coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing CML progression protein coding sequences; or mammalian cell systems (e.g., COS, CHO, BHK, 293, 3T3, N2a) harboring recombinant expression constructs containing promoters derived from the genome of mammalian cells (e.g., metallothionein promoter) or from mammalian viruses (e.g., the adenovirus late promoter; the vaccinia virus 7.5K promoter).

In bacterial systems, a number of expression vectors may be advantageously selected depending upon the use intended for the CML progression protein being expressed. For example, when a large quantity of such a protein is to be produced, for the generation of pharmaceutical compositions of CML progression protein protein or for raising antibodies to CML progression protein protein, for example, vectors which direct the expression of high levels of fusion protein products that are readily purified may be desirable. Such vectors include, but are not limited, to the *E. coli* expression vector pUR278 (Ruther et al., 1983, EMBO J. 2:1791), in which the CML progression protein coding sequence may be ligated individually into the vector in frame with the lac Z coding region so that a fusion protein is produced; pIN vectors (Inouye & Inouye, 1985, Nucleic Acids Res. 13:3101-3109; Van Heeke & Schuster, 1989, J. Biol. Chem. 264:5503-5509); and the like. pGEX vectors may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. The pGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus grows in *Spodoptera frugiperda* cells. The CML progression gene coding sequence may be cloned individually into non-essential regions (for example the polyhedrin gene) of the virus and placed under control of an AcNPV promoter (for example the polyhedrin promoter). Successful insertion of CML progression gene coding sequence will result in inactivation of the polyhedrin gene and production of non-occluded recombinant virus (i.e., virus lacking the proteinaceous coat coded for by the polyhedrin gene). These recombinant viruses are then used to infect *Spodoptera frugiperda* cells in which the inserted gene is expressed. (E.g., see Smith et al., 1983, J. Virol. 46: 584; Smith, U.S. Pat. No. 4,215,051).

In mammalian host cells, a number of viral-based expression systems may be utilized. In cases where an adenovirus is used as an expression vector, the CML progression gene coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing CML progression protein in infected hosts. (E.g., See Logan & Shenk, 1984, Proc. Natl. Acad. Sci. USA 81:3655-3659). Specific initiation signals may also be required for efficient translation of inserted CML progression protein coding sequences. These signals include the ATG initiation codon and adjacent sequences. In cases where an entire CML progression gene, including its own initiation codon and adjacent sequences, is inserted into the appropriate expression vector, no additional translational control signals may be needed. However, in cases where only a portion of the CML progression gene coding sequence is inserted, exogenous translational control signals, including, perhaps, the ATG initiation codon, must be provided. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see Bittner et al., 1987, Methods in Enzymol. 153:516-544).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include but are not limited to CHO, VERO, BHK, HeLa, COS, MDCK, 293, 3T3, W138.

For long-term, high-yield production of recombinant proteins, stable expression is preferred. For example, cell lines which stably express the CML progression protein may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the CML progression protein. Such engineered cell lines may be particularly useful in screening and evaluation of compounds that affect the endogenous activity of the CML progression protein.

In another embodiment, the expression characteristics of an endogenous gene (e.g., a CML progression gene) within a cell, cell line or microorganism may be modified by inserting a DNA regulatory element heterologous to the endogenous gene of interest into the genome of a cell, stable cell line or cloned microorganism such that the inserted regulatory element is operatively linked with the endogenous gene (e.g., a CML progression gene) and controls, modulates, activates, or inhibits the endogenous gene. For example, endogenous CML progression genes which are normally "transcriptionally silent", i.e., a CML progression gene which is normally not expressed, or is expressed only at very low levels in a cell line or microorganism, may be activated by inserting a regulatory element which is capable of promoting the expression of the gene product in that cell line or microorganism. Alternatively, transcriptionally silent, endogenous CML progression genes may be activated by insertion of a promiscuous regulatory element that works across cell types.

A heterologous regulatory element may be inserted into a stable cell line or cloned microorganism, such that it is operatively linked with and activates or inhibits expression of endogenous CML progression genes, using techniques, such as targeted homologous recombination, which are well known to those of skill in the art, and described e.g., in Chappel, U.S. Pat. No. 5,272,071; PCT Publication No. WO 91/06667 published May 16, 1991; Skoultchi, U.S. Pat. No. 5,981,214; and Treco et al U.S. Pat. No. 5,968,502 and PCT Publication No. WO 94/12650 published Jun. 9, 1994. Alternatively, non-targeted, e.g. non-homologous recombination techniques may be used which are well-known to those of skill in the art and described, e.g., in PCT Publication No. WO 99/15650 published Apr. 1, 1999.

CML progression gene activation (or inactivation) may also be accomplished using designer transcription factors using techniques well known in the art. Briefly, a designer zinc finger protein transcription factor (ZFP-TF) is made which is specific for a regulatory region of the CML progression gene to be activated or inactivated. A construct encoding this designer ZFP-TF is then provided to a host cell in which the CML progression gene is to be controlled. The construct directs the expression of the designer ZFP-TF protein, which in turn specifically modulates the expression of the endogenous CML progression gene. The following references relate to various aspects of this approach in further detail: Wang & Pabo, 1999, Proc. Natl. Acad. Sci. USA 96, 9568; Berg, 1997, Nature Biotechnol. 15, 323; Greisman & Pabo, 1997, Science 275, 657; Berg & Shi, 1996, Science 271, 1081; Rebar & Pabo, 1994, Science 263, 671; Rhodes & Klug, 1993, Scientific American 269, 56; Pavletich & Pabo, 1991, Science 252, 809; Liu et al., 2001, J. Biol. Chem. 276, 11323; Zhang et al., 2000, J. Biol. Chem. 275, 33850; Beerli et al., 2000, Proc. Natl. Acad. Sci. USA 97, 1495; Kang et al., 2000, J. Biol. Chem. 275, 8742; Beerli et al., 1998, Proc. Natl. Acad. Sci. USA 95, 14628; Kim & Pabo, 1998, Proc. Natl. Acad. Sci. USA 95, 2812; Choo et al., 1997, J. Mol. Biol. 273, 525; Kim & Pabo, 1997, J. Biol. Chem. 272, 29795; Liu et al, 1997, Proc. Natl. Acad. Sci. USA 94, 5525; Kim et al, 1997, Proc. Natl. Acad. Sci. USA 94, 3616; Kikyo et al., 2000, Science 289, 2360; Robertson & Wolffe, 2000, Nature Reviews 1, 11; and Gregory, 2001, Curr. Opin. Genet. Devt. 11, 142.

A number of selection systems may be used, including but not limited to the herpes simplex virus thymidine kinase (Wigler, et al., 1977, Cell 11:223), hypoxanthine-guanine phosphoribosyltransferase (Szybalska & Szybalski, 1962, Proc. Natl. Acad. Sci. USA 48:2026), and adenine phosphoribosyltransferase (Lowy, et al., 1980, Cell 22:817) genes can be employed in tk⁻, hgprt⁻ or aprt⁻ cells, respectively. Also, antimetabolite resistance can be used as the basis of selection for the following genes: dhfr, which confers resistance to methotrexate (Wigler, et al., 1980, Natl. Acad. Sci. USA 77:3567; O'Hare, et al., 1981, Proc. Natl. Acad. Sci. USA 78:1527); gpt, which confers resistance to mycophenolic acid (Mulligan & Berg, 1981, Proc. Natl. Acad. Sci. USA 78:2072); neo, which confers resistance to the aminoglycoside G-418 (Colberre-Garapin, et al., 1981, J. Mol. Biol. 150:1); and hygro, which confers resistance to hygromycin (Santerre, et al., 1984, Gene 30:147).

Alternatively, any fusion protein may be readily purified by utilizing an antibody specific for the fusion protein being expressed. For example, a system described by Janknecht et al. allows for the ready purification of non-denatured fusion proteins expressed in human cell lines (Janknecht, et al., 1991, Proc. Natl. Acad. Sci. USA 88: 8972-8976). In this system, the gene of interest is subcloned into a vaccinia recombination plasmid such that the gene's open reading frame is translationally fused to an amino-terminal tag consisting of six histidine residues. Extracts from cells infected with recombinant vaccinia virus are loaded onto $Ni^{2+}$.nitrilo-acetic acid-agarose columns and histidine-tagged proteins are selectively eluted with imidazole-containing buffers.

In a specific embodiment, recombinant human CML progression proteins can be expressed as a fusion protein with glutathione S-transferase at the amino-terminus (GST-CML progression protein) using standard baculovirus vectors and a (Bac-to-Bac®) insect cell expression system purchased from GIBCO™ Invitrogen. Recombinant protein expressed in insect cells can be purified using glutathione sepharose (Amersham Biotech) using standard procedures described by the manufacturer.

5.8. Production of Antibodies that Bind a CML Progression/Target or IM Resistance Protein CML progression protein or a fragment thereof can be used to raise antibodies which bind CML progression protein. Such antibodies include but are not limited to polyclonal, monoclonal, chimeric, single chain, Fab fragments, and an Fab expression library. In a preferred embodiment, anti CML progression protein C-terminal antibodies are raised using an appropriate C-terminal fragment of a CML progression protein, e.g., the kinase domain. Such antibodies bind the kinase domain of the CML progression protein. In another preferred embodiment, anti CML progression protein N-terminal antibodies are raised using an appropriate N-terminal fragment of a CML progression protein. The N-terminal domain of a CML progression protein are less homologous to other kinases, and therefore offered a more specific target for a particular CML progression protein.

5.8.1. Production of Monoclonal Antibodies Specific for a CML Progression/Target of IM Resistance Protein Antibodies can be prepared by immunizing a suitable subject with a CML progression protein or a fragment thereof as an immunogen. The antibody titer in the immunized subject can be monitored over time by standard techniques, such as with an enzyme linked immunosorbent assay (ELISA) using immobilized polypeptide. If desired, the antibody molecules can be isolated from the mammal (e.g., from the blood) and further purified by well-known techniques, such as protein A chromatography to obtain the IgG fraction.

At an appropriate time after immunization, e.g., when the specific antibody titers are highest, antibody-producing cells can be obtained from the subject and used to prepare monoclonal antibodies by standard techniques, such as the hybridoma technique originally described by Kohler and Milstein (1975, Nature 256:495-497), the human B cell hybridoma technique by Kozbor et al. (1983, Immunol. Today 4:72), the EBV-hybridoma technique by Cole et al. (1985, Monoclonal Antibodies and Cancer Therapy, Alan R. Liss, Inc., pp. 77-96) or trioma techniques. The technology for producing hybridomas is well known (see Current Protocols in Immunology, 1994, John Wiley & Sons, Inc., New York, N.Y.). Hybridoma cells producing a monoclonal antibody are detected by screening the hybridoma culture supernatants for antibodies that bind the polypeptide of interest, e.g., using a standard ELISA assay.

Monoclonal antibodies are obtained from a population of substantially homogeneous antibodies, i.e., the individual antibodies comprising the population are identical except for possible naturally occurring mutations that may be present in minor amounts. Thus, the modifier "monoclonal" indicates the character of the antibody as not being a mixture of discrete antibodies. For example, the monoclonal antibodies may be made using the hybridoma method first described by Kohler et al., 1975, Nature, 256:495, or may be made by recombinant DNA methods (U.S. Pat. No. 4,816,567). The term "monoclonal antibody" as used herein also indicates that the antibody is an immunoglobulin.

In the hybridoma method of generating monoclonal antibodies, a mouse or other appropriate host animal, such as a hamster, is immunized as hereinabove described to elicit lymphocytes that produce or are capable of producing antibodies that will specifically bind to the protein used for immunization (see, e.g., U.S. Pat. No. 5,914,112, which is incorporated herein by reference in its entirety).

Alternatively, lymphocytes may be immunized in vitro. Lymphocytes then are fused with myeloma cells using a suitable fusing agent, such as polyethylene glycol, to form a hybridoma cell (Goding, Monoclonal Antibodies: Principles and Practice, pp. 59-103 (Academic Press, 1986)). The hybridoma cells thus prepared are seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells.

Preferred myeloma cells are those that fuse efficiently, support stable high-level production of antibody by the selected antibody-producing cells, and are sensitive to a medium such as HAT medium. Among these, preferred myeloma cell lines are murine myeloma lines, such as those derived from MOPC-21 and MPC-11 mouse tumors available from the Salk Institute Cell Distribution Center, San Diego, Calif. USA, and SP-2 cells available from the American Type Culture Collection, Rockville, Md. USA.

Human myeloma and mouse-human heteromyeloma cell lines also have been described for the production of human monoclonal antibodies (Kozbor, 1984, J. Immunol., 133:3001; Brodeur et al., Monoclonal Antibody Production Techniques and Applications, pp. 51-63 (Marcel Dekker, Inc., New York, 1987)). Culture medium in which hybridoma cells are growing is assayed for production of monoclonal antibodies directed against the antigen. Preferably, the binding specificity of monoclonal antibodies produced by hybridoma cells is determined by immunoprecipitation or by an in vitro binding assay, such as radioimmunoassay (RIA) or enzyme-linked immuno-absorbent assay (ELISA). The binding affinity of the monoclonal antibody can, for example, be determined by the Scatchard analysis of Munson et al., 1980, Anal. Biochem., 107:220.

After hybridoma cells are identified that produce antibodies of the desired specificity, affinity, and/or activity, the clones may be subcloned by limiting dilution procedures and grown by standard methods (Goding, Monoclonal Antibodies: Principles and Practice, pp. 59-103, Academic Press, 1986). Suitable culture media for this purpose include, for example, D-MEM or RPMI-1640 medium. In addition, the hybridoma cells may be grown in vivo as ascites tumors in an animal. The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

Alternative to preparing monoclonal antibody-secreting hybridomas, a monoclonal antibody directed against a CML progression protein or a fragment thereof can be identified and isolated by screening a recombinant combinatorial immunoglobulin library (e.g., an antibody phage display library) with the CML progression protein or the fragment. Kits for generating and screening phage display libraries are commercially available (e.g., Pharmacia Recombinant Phage Antibody System, Catalog No. 27-9400-01; and the Stratagene antigen SurfZAP™ Phage Display Kit, Catalog No. 240612). Additionally, examples of methods and reagents particularly amenable for use in generating and screening antibody display library can be found in, for example, U.S. Pat. Nos. 5,223,409 and 5,514,548; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al., 1991, Bio/Technology 9:1370-1372; Hay et al., 1992, Hum. Antibod. Hybridomas 3:81-85; Huse et al., 1989, Science 246:1275-1281; Griffiths et al., 1993, EMBO J. 12:725-734.

In addition, techniques developed for the production of "chimeric antibodies" (Morrison, et al., 1984, Proc. Natl. Acad. Sci., 81, 6851-6855; Neuberger, et al., 1984, Nature 312, 604-608; Takeda, et al., 1985, Nature, 314, 452-454) by splicing the genes from a mouse antibody molecule of appropriate antigen specificity together with genes from a human antibody molecule of appropriate biological activity can be used. A chimeric antibody is a molecule in which different portions are derived from different animal species, such as those having a variable region derived from a murine mAb and a human immunoglobulin constant region. (See, e.g., Cabilly et al., U.S. Pat. No. 4,816,567; and Boss et al., U.S. Pat. No. 4,816,397, which are incorporated herein by reference in their entirety.)

Humanized antibodies are antibody molecules from non-human species having one or more complementarity determining regions (CDRs) from the non-human species and a framework region from a human immunoglobulin molecule. (see e.g., U.S. Pat. No. 5,585,089, which is incorporated herein by reference in its entirety.) Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. Nos. 4,816,567 and 5,225,539; European Patent Application 125,023; Better et al., 1988, Science 240:1041-1043; Liu et al., 1987, Proc. Natl. Acad. Sci. USA 84:3439-3443; Liu et al., 1987, J. Immunol. 139:3521-3526; Sun et al., 1987, Proc. Natl. Acad. Sci. USA 84:214-218; Nishimura et al., 1987, Canc. Res. 47:999-1005; Wood et al., 1985, Nature 314:446-449; Shaw et al., 1988, J. Natl. Cancer Inst. 80:1553-1559; Morrison 1985, Science 229:1202-1207; Oi et al., 1986, Bio/Techniques 4:214; Jones et al., 1986, Nature 321:552-525; Verhoeyan et al., 1988, Science 239:1534; and Beidler et al., 1988, J. Immunol. 141: 4053-4060.

Complementarity determining region (CDR) grafting is another method of humanizing antibodies. It involves reshaping murine antibodies in order to transfer full antigen specificity and binding affinity to a human framework (Winter et al.

U.S. Pat. No. 5,225,539). CDR-grafted antibodies have been successfully constructed against various antigens, for example, antibodies against IL-2 receptor as described in Queen et al., 1989 (Proc. Natl. Acad. Sci. USA 86:10029); antibodies against cell surface receptors-CAMPATH as described in Riechmann et al. (1988, Nature, 332:323; antibodies against hepatitis B in Cole et al. (1991, Proc. Natl. Acad. Sci. USA 88:2869); as well as against viral antigens-respiratory syncitial virus in Tempest et al. (1991, Bio-Technology 9:267). CDR-grafted antibodies are generated in which the CDRs of the murine monoclonal antibody are grafted into a human antibody. Following grafting, most antibodies benefit from additional amino acid changes in the framework region to maintain affinity, presumably because framework residues are necessary to maintain CDR conformation, and some framework residues have been demonstrated to be part of the antigen binding site. However, in order to preserve the framework region so as not to introduce any antigenic site, the sequence is compared with established germline sequences followed by computer modeling.

Completely human antibodies are particularly desirable for therapeutic treatment of human patients. Such antibodies can be produced using transgenic mice which are incapable of expressing endogenous immunoglobulin heavy and light chain genes, but which can express human heavy and light chain genes. The transgenic mice are immunized in the normal fashion with a CML progression protein.

Monoclonal antibodies directed against a CML progression protein can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995, Int. Rev. Immunol. 13:65-93). For a detailed discussion of this technology for producing human antibodies and human monoclonal antibodies and protocols for producing such antibodies, see e.g., U.S. Pat. No. 5,625,126; U.S. Pat. No. 5,633,425; U.S. Pat. No. 5,569,825; U.S. Pat. No. 5,661,016; and U.S. Pat. No. 5,545,806. In addition, companies such as Abgenix, Inc. (Freemont, Calif., see, for example, U.S. Pat. No. 5,985,615) and Medarex, Inc. (Princeton, N.J.), can be engaged to provide human antibodies directed against a CML progression protein or a fragment thtereof using technology similar to that described above.

Completely human antibodies which recognize and bind a selected epitope can be generated using a technique referred to as "guided selection." In this approach a selected non-human monoclonal antibody, e.g., a mouse antibody, is used to guide the selection of a completely human antibody recognizing the same epitope (Jespers et al., 1994, Bio/technology 12:899-903).

A pre-existing anti-CML progression protein antibody can be used to isolate additional antigens of the CML progression protein by standard techniques, such as affinity chromatography or immunoprecipitation for use as immunogens. Moreover, such an antibody can be used to detect the protein (e.g., in a cellular lysate or cell supernatant) in order to evaluate the abundance and pattern of expression of CML progression protein. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include 125I, 131I, 35S or 3H.

5.8.2. Production of Polyclonal anti-CML Progression/Target or IM Resistance Protein Antibodies The anti-CML progression protein antibodies can be produced by immunization of a suitable animal, such as but are not limited to mouse, rabbit, and horse.

An immunogenic preparation comprising a CML progression protein or a fragment thereof can be used to prepare antibodies by immunizing a suitable subject (e.g., rabbit, goat, mouse or other mammal). An appropriate immunogenic preparation can contain, for example, recombinantly expressed or chemically synthesized CML progression protein peptide or polypeptide. The preparation can further include an adjuvant, such as Freund's complete or incomplete adjuvant, or similar immunostimulatory agent.

A fragment of a CML progression protein suitable for use as an immunogen comprises at least a portion of the CML progression protein that is 8 amino acids, more preferably 10 amino acids and more preferably still, 15 amino acids long.

The invention also provides chimeric or fusion CML progression protein polypeptides for use as immunogens. As used herein, a "chimeric" or "fusion" CML progression protein polypeptide comprises all or part of a CML progression protein polypeptide operably linked to a heterologous polypeptide. Within the fusion CML progression protein polypeptide, the term "operably linked" is intended to indicate that the CML progression protein polypeptide and the heterologous polypeptide are fused in-frame to each other. The heterologous polypeptide can be fused to the N-terminus or C-terminus of the CML progression protein polypeptide.

One useful fusion CML progression protein polypeptide is a GST fusion CML progression protein polypeptide in which the CML progression protein polypeptide is fused to the C-terminus of GST sequences. Such fusion CML progression protein polypeptides can facilitate the purification of a recombinant CML progression protein polypeptide.

In another embodiment, the fusion CML progression protein polypeptide contains a heterologous signal sequence at its N-terminus so that the CML progression protein polypeptide can be secreted and purified to high homogeneity in order to produce high affinity antibodies. For example, the native signal sequence of an immunogen can be removed and replaced with a signal sequence from another protein. For example, the gp67 secretory sequence of the baculovirus envelope protein can be used as a heterologous signal sequence (Current Protocols in Molecular Biology, Ausubel et al., eds., John Wiley & Sons, 1992). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal and the protein A secretory signal (Pharmacia Biotech; Piscataway, N.J.).

In yet another embodiment, the fusion CML progression protein polypeptide is an immunoglobulin fusion protein in which all or part of a CML progression protein polypeptide is fused to sequences derived from a member of the immunoglobulin protein family. The immunoglobulin fusion proteins can be used as immunogens to produce antibodies directed against the CML progression protein polypetide in a subject.

Chimeric and fusion CML progression protein polypeptide can be produced by standard recombinant DNA techniques. In one embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (e.g., Ausubel et al., supra). Moreover, many expression vectors are commercially available that already encode a fusion domain (e.g., a GST polypeptide). A nucleic acid encoding an immunogen can be cloned into such an expression vector such that the fusion domain is linked in-frame to the polypeptide.

The CML progression protein immunogenic preparation is then used to immunize a suitable animal. Preferably, the animal is a specialized transgenic animal that can secret human antibody. Non-limiting examples include transgenic mouse strains which can be used to produce a polyclonal population of antibodies directed to a specific pathogen (Fishwild et al., 1996, Nature Biotechnology 14:845-851; Mendez et al., 1997, Nature Genetics 15:146-156). In one embodiment of the invention, transgenic mice that harbor the unrearranged human immunoglobulin genes are immunized with the target immunogens. After a vigorous immune response against the immunogenic preparation has been elicited in the mice, the blood of the mice are collected and a purified preparation of human IgG molecules can be produced from the plasma or serum. Any method known in the art can be used to obtain the purified preparation of human IgG molecules, including but is not limited to affinity column chromatography using anti-human IgG antibodies bound to a suitable column matrix. Anti-human IgG antibodies can be obtained from any sources known in the art, e.g., from commercial sources such as Dako Corporation and ICN. The preparation of IgG molecules produced comprises a polyclonal population of IgG molecules that bind to the immunogen or immunogens at different degree of affinity. Preferably, a substantial fraction of the preparation contains IgG molecules specific to the immunogen or immunogens. Although polyclonal preparations of IgG molecules are described, it is understood that polyclonal preparations comprising any one type or any combination of different types of immunoglobulin molecules are also envisioned and are intended to be within the scope of the present invention.

A population of antibodies directed to a CML progression protein can be produced from a phage display library. Polyclonal antibodies can be obtained by affinity screening of a phage display library having a sufficiently large and diverse population of specificities with a CML progression protein or a fragment thereof. Examples of methods and reagents particularly amenable for use in generating and screening antibody display library can be found in, for example, U.S. Pat. Nos. 5,223,409 and 5,514,548; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al., 1991, Bio/Technology 9:1370-1372; Hay et al., 1992, Hum. Antibod. Hybridomas 3:81-85; Huse et al., 1989, Science 246:1275-1281; Griffiths et al., 1993, EMBO J. 12:725-734. A phage display library permits selection of desired antibody or antibodies from a very large population of specificities. An additional advantage of a phage display library is that the nucleic acids encoding the selected antibodies can be obtained conveniently, thereby facilitating subsequent construction of expression vectors.

In other preferred embodiments, the population of antibodies directed to a CML progression protein or a fragment thereof is produced by a method using the whole collection of selected displayed antibodies without clonal isolation of individual members as described in U.S. Pat. No. 6,057,098, which is incorporated by reference herein in its entirety. Polyclonal antibodies are obtained by affinity screening of a phage display library having a sufficiently large repertoire of specificities with, e.g., an antigenic molecule having multiple epitopes, preferably after enrichment of displayed library members that display multiple antibodies. The nucleic acids encoding the selected display antibodies are excised and amplified using suitable PCR primers. The nucleic acids can be purified by gel electrophoresis such that the full length nucleic acids are isolated. Each of the nucleic acids is then inserted into a suitable expression vector such that a population of expression vectors having different inserts is obtained. The population of expression vectors is then expressed in a suitable host.

5.8.3 Production of Antibody-Drug Conjugates Targeting a CML Progression/Target of IM Resistance Protein Cancer cells can be targeted and killed using anti-CML progression protein antibody-drug conjugates that target an advanced phase CML hematopoetic stem cell and/or immature myeloid cell expressing a CML progression protein on its surface, e.g., PRAME. For example, an antibody specific for a CML progression protein may be conjugated to a therapeutic moiety such as a cytotoxin, e.g., a cytostatic or cytocidal agent, or a radioactive metal ion. Antibody-drug conjugates can be prepared by method known in the art (see, e.g., Immunoconjugates, Vogel, ed. 1987; Targeted Drugs, Goldberg, ed. 1983; Antibody Mediated Delivery Systems, Rodwell, ed. 1988). Therapeutic drugs, such as but are not limited to, paclitaxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof, can be conjugated to anti-CML progression protein antibodies. Other therapeutic agents that can be conjugated to anti-CML progression protein antibodies include, but are not limited to, antimetabolites, e.g., methotrexate, 6-mercaptopurine, 6-thioguanine, cytarabine, 5-fluorouracil decarbazine; alkylating agents, e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin; anthracyclines, e.g., daunorubicin (daunomycin) and doxorubicin; antibiotics, e.g., dactinomycin (actinomycin), bleomycin, mithramycin, anthramycin (AMC); and anti-mitotic agents, e.g., vincristine and vinblastine. The therapeutic agents that can be conjugated to anti-CML progression protein antibodies may also be a protein or polypeptide possessing a desired biological activity. Other chemotherapeutic agents known in the art, such as those described in Section 5.8.5, infra, can also be conjugated with such an anti-CML progression protein antibody. Such proteins may include, for example, a toxin such as abrin, ricin A, pseudomonas exotoxin, or diphtheria toxin.

The drug molecules can be linked to the anti-CML progression protein antibody via a linker. Any suitable linker can be used for the preparation of such conjugates. In some embodiments, the linker can be a linker that allows the drug molecules to be released from the conjugates in unmodified form at the target site.

The antibodies can also be used diagnostically to, for example, monitor the presence of cancer cells as part of a clinical testing procedure to, e.g., determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, radioactive materials, positron emitting metals using various positron emission tomographies, and nonradioactive paramagnetic metal ions. See generally U.S. Pat. No. 4,741,900 for metal ions which can be conjugated to antibodies for use as diagnostics according to the present invention. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include fluorescent proteins, e.g., green fluorescent protein (GFP), umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{111}$In, $^{177}$Lu, $^{90}$Y or $^{99}$Tc.

Techniques for conjugating therapeutic moieties to antibodies are well known, see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62:119-58 (1982); each of which is incorporated herein by reference.

Alternatively, an antibody can be conjugated to a second antibody to form an antibody heteroconjugate as described by Segal in U.S. Pat. No. 4,676,980, which is incorporated herein by reference.

5.8.4 Production of Peptides

A CML progression protein-binding peptide or polypeptide or peptide or polypeptide of a CML progression protein may be produced by recombinant DNA technology using techniques well known in the art. Thus; the polypeptide or peptide can be produced by expressing nucleic acid containing sequences encoding the polypeptide or peptide. Methods which are well known to those skilled in the art can be used to construct expression vectors containing coding sequences and appropriate transcriptional and translational control signals. These methods include, for example, in vitro recombinant DNA techniques, synthetic techniques, and in vivo genetic recombination. See, for example, the techniques described in Sambrook et al., 1989, supra, and Ausubel et al., 1989, supra. Alternatively, RNA capable of encoding CML progression protein polypeptide sequences may be chemically synthesized using, for example, synthesizers. See, for example, the techniques described in "Oligonucleotide Synthesis", 1984, Gait, M. J. ed., IRL Press, Oxford, which is incorporated herein by reference in its entirety.

5.8.5 Chemotherapeutic Drugs

The invention can be practiced with any known chemotherapeutic drugs, including but not limited to DNA damaging agents, anti-metabolites, anti-mitotic agents, or a combination of two or more of such known anti-cancer agents.

DNA damage agents cause chemical damage to DNA and/or RNA. DNA damage agents can disrupt DNA replication or cause the generation of nonsense DNA or RNA. DNA damaging agents include but are not limited to topoisomerase inhibitor, DNA binding agent, and ionizing radiation. A topoisomerase inhibitor that can be used in conjunction with the invention can be a topoisomerase I (Topo I) inhibitor, a topoisomerase II (Topo II) inhibitor, or a dual topoisomerase I and II inhibitor. A topo I inhibitor can be for example from any of the following classes of compounds: camptothecin analogue (e.g., karenitecin, aminocamptothecin, lurtotecan, topotecan, irinotecan, BAY 56-3722, rubitecan, GI14721, exatecan mesylate), rebeccamycin analogue, PNU 166148, rebeccamycin, TAS-103, camptothecin (e.g., camptothecin polyglutamate, camptothecin sodium), intoplicine, ecteinascidin 743, J-107088, pibenzimol. Examples of preferred topo I inhibitors include but are not limited to camptothecin, topotecan (hycaptamine), irinotecan (irinotecan hydrochloride), belotecan, or an analogue or derivative of any of the foregoing.

A topo II inhibitor that can be used in conjunction with the invention can be for example from any of the following classes of compounds: anthracycline antibiotics (e.g., carubicin, pirarubicin, daunorubicin citrate liposomal, daunomycin, 4-iodo-4-doxydoxorubicin, doxorubicin, n,n-dibenzyl daunomycin, morpholinodoxorubicin, aclacinomycin antibiotics, duborimycin, menogaril, nogalamycin, zorubicin, epirubicin, marcellomycin, detorubicin, annamycin, 7-cyanoquinocarcinol, deoxydoxorubicin, idarubicin, GPX-100, MEN-10755, valrubicin, KRN5500), epipodophyllotoxin compound (e.g., podophyllin, teniposide, etoposide, GL331, 2-ethylhydrazide), anthraquinone compound (e.g., ametantrone, bisantrene, mitoxantrone, anthraquinone), ciprofloxacin, acridine carboxamide, amonafide, anthrapyrazole antibiotics (e.g., teloxantrone, sedoxantrone trihydrochloride, piroxantrone, anthrapyrazole, losoxantrone), TAS-103, fostriecin, razoxane, XK469R, XK469, chloroquinoxaline sulfonamide, merbarone, intoplicine, elsamitrucin, CI-921, pyrazoloacridine, elliptinium, amsacrine. Examples of preferred topo II inhibitors include but are not limited to doxorubicin (Adriamycin), etoposide phosphate (etopofos), teniposide, sobuzoxane, or an analogue or derivative of any of the foregoing.

DNA binding agents that can be used in conjunction with the invention include but are not limited to a DNA groove binding agent, e.g., DNA minor groove binding agent; DNA crosslinking agent; intercalating agent; and DNA adduct forming agent. A DNA minor groove binding agent can be an anthracycline antibiotic, mitomycin antibiotic (e.g., porfiromycin, KW-2149, mitomycin B, mitomycin A, mitomycin C), chromomycin A3, carzelesin, actinomycin antibiotic (e.g., cactinomycin, dactinomycin, actinomycin F1), brostallicin, echinomycin, bizelesin, duocarmycin antibiotic (e.g., KW 2189), adozelesin, olivomycin antibiotic, plicamycin, zinostatin, distamycin, MS-247, ecteinascidin 743, amsacrine, anthramycin, and pibenzimol, or an analogue or derivative of any of the foregoing.

DNA crosslinking agents include but are not limited to antineoplastic alkylating agent, methoxsalen, mitomycin antibiotic, psoralen. An antineoplastic alkylating agent can be a nitrosourea compound (e.g., cystemustine, tauromustine, semustine, PCNU, streptozocin, SarCNU, CGP-6809, carmustine, fotemustine, methylnitrosourea, nimustine, ranimustine, ethylnitrosourea, lomustine, chlorozotocin), mustard agent (e.g., nitrogen mustard compound, such as spiromustine, trofosfamide, chlorambucil, estramustine, 2,2,2-trichlorotriethylamine, prednimustine, novembichin, phenamet, glufosfamide, peptichemio, ifosfamide, defosfamide, nitrogen mustard, phenesterin, mannomustine, cyclophosphamide, melphalan, perfosfamide, mechlorethamine oxide hydrochloride, uracil mustard, bestrabucil, DHEA mustard, tallimustine, mafosfamide, aniline mustard, chlornaphazine; sulfur mustard compound, such as bischloroethylsulfide; mustard prodrug, such as TLK286 and ZD2767), ethylenimine compound (e.g., mitomycin antibiotic, ethylenimine, uredepa, thiotepa, diaziquone, hexamethylene bisacetamide, pentamethylmelamine, altretamine, carzinophilin, triaziquone, meturedepa, benzodepa, carboquone), alkylsulfonate compound (e.g., dimethylbusulfan, Yoshi-864, improsulfan, piposulfan, treosulfan, busulfan, hepsulfam), epoxide compound (e.g., anaxirone, mitolactol, dianhydrogalactitol, teroxirone), miscellaneous alkylating agent (e.g., ipomeanol, carzelesin, methylene dimethane sulfonate, mitobronitol, bizelesin, adozelesin, piperazinedione, VNP40101M, asaley, 6-hydroxymethylacylfulvene, EO9, etoglucid, ecteinascidin 743, pipobroman), platinum compound (e.g., ZD0473, liposomal-cisplatin analogue, satraplatin, BBR 3464, spiroplatin, ormaplatin, cisplatin, oxaliplatin, carboplatin, lobaplatin, zeniplatin, iproplatin), triazene compound (e.g., imidazole mustard, CB10-277, mitozolomide, temozolomide, procarbazine, dacarbazine), picoline compound (e.g., penclomedine), or an analogue or derivative of any of the foregoing. Examples of preferred alkylating agents include but are not limited to cisplatin, dibromodulcitol, fotemustine, ifosfamide (ifosfamid), ranimustine (ranomustine), nedaplatin (latoplatin), bendamustine (bendamustine hydrochloride), eptaplatin, temozolomide (methazolastone), carboplatin, altretamine (hexamethylmelamine), prednimustine, oxaliplatin (oxalaplatinum), carmustine, thiotepa, leusulfon (busulfan), lobaplatin, cyclophosphamide, bisulfan, melphalan, and chlorambucil, or an analogue or derivative of any of the foregoing.

Intercalating agents can be an anthraquinone compound, bleomycin antibiotic, rebeccamycin analogue, acridine, acridine carboxamide, amonafide, rebeccamycin, anthrapyrazole antibiotic, echinomycin, psoralen, LU 79553, BW A773U, crisnatol mesylate, benzo(a)pyrene-7,8-diol-9,10-epoxide, acodazole, elliptinium, pixantrone, or an analogue or derivative of any of the foregoing.

DNA adduct forming agents include but are not limited to enediyne antitumor antibiotic (e.g., dynemicin A, esperamicin A1, zinostatin, dynemicin, calicheamicin gamma II), platinum compound, carmustine, tamoxifen (e.g., 4-hydroxytamoxifen), psoralen, pyrazine diazohydroxide, benzo(a)pyrene-7,8-diol-9,10-epoxide, or an analogue or derivative of any of the foregoing.

Anti-metabolites block the synthesis of nucleotides or deoxyribonucleotides, which are necessary for making DN, thereby preventing cells from replicating. Anti-metabolites include but are not limited to cytosine, arabinoside, floxuridine, 5-fluorouracil (5-FU), mercaptopurine, gemcitabine, hydroxyurea (HU), and methotrexate (MTX).

Anti-mitotic agents disrupt the the development of the mitotic spindle thereby interfering with tumor cell proliferation. Anti-mitotic agents include but are not limited to Vinblastine, Vincristine, and Pacitaxel (Taxol). Anti-mitotic agents also includes agents that target the enzymes that regulate mitosis, e.g., agents that target kinesin spindle protein (KSP), e.g., L-001000962-000Y.

5.9. Kits

The invention provides kits that are useful in determining the stage of CML in a patient. The kits of the present invention comprise one or more probes and/or primers for each of at least 5, 10, 20, 30, 40, 50, 60, 70, 80, or 100 gene products that are encoded by the respectively marker genes listed in Tables 1a and/or 1b or functional equivalents of such genes, wherein the probes and/or primers are at least 50%, 75%, 80%, 85%, 90%, 95%, 97%, 98%, 99% or 100% of the total probes and/or primers in the kit. The probes of marker genes may be part of an array, or the biomarker(s) may be packaged separately and/or individually.

The invention provides kits that are useful in determining the progression of CML in a patient. The kits of the present invention comprise one or more probes and/or primers for each of at least 5, 10, 20, 30, 40, 50, 60, 70, 80, or 100 gene products that are encoded by the respectively marker genes listed in Tables 2a and/or 2b or functional equivalents of such genes, wherein the probes and/or primers are at least 50%, 75%, 80%, 85%, 90%, 95%, 97%, 98%, 99% or 100% of the total probes and/or primers in the kit. In a preferred embodiment, the kits comprise one or more probes and/or primers for each of at least 5, 10, 20, 30, 40, 50, 60, 70, 80, or 100 gene products that are encoded by the respectively marker genes listed in Table 4 or functional equivalents of such genes, wherein the probes and/or primers are at least 50%, 75%, 80%, 85%, 90%, 95%, 97%, 98%, 99% or 100% of the total probes and/or primers in the kit. The probes of marker genes may be part of an array, or the biomarker(s) may be packaged separately and/or individually.

In one embodiment, the invention provides kits comprising probes that are immobilized at an addressable position on a substrate, e.g., in a microarray. In a particular embodiment, the invention provides such a microarray.

The kits of the present invention may also contain probes that can be used to detect protein products of the marker genes of the invention. In a specific embodiment, the invention provides a kit comprises a plurality of antibodies that specifically bind a plurality of at least 5, 10, 20, 30, 40, 50, 60, 70, 80, or 100 proteins that are encoded by the respectively marker genes listed in Tables 1a and/or 1b or any one of Tables 2a and/or 2b and 5a and/or 5b or functional equivalents of such genes, wherein the antibodies are at least 50%, 75%, 80%, 85%, 90%, 95%, 97%, 98%, 99% or 100% of the total antibodies in the kit. In accordance with this embodiment, the kit may comprise a set of antibodies or functional fragments or derivatives thereof (e.g., Fab, F(ab')$_2$, Fv, or scFv fragments). In accordance with this embodiment, the kit may include antibodies, fragments or derivatives thereof (e.g., Fab, F(ab')$_2$, Fv, or scFv fragments) that are specific for these proteins. In one embodiment, the antibodies may be detectably labeled.

The kits of the present invention may also include reagents such as buffers, or other reagents that can be used in obtaining the marker profile. Prevention of the action of microorganisms can be ensured by the inclusion of various antibacterial and antifungal agents, for example, paraben, chlorobutanol, phenol sorbic acid, and the like. It may also be desirable to include isotonic agents such as sugars, sodium chloride, and the like.

In some embodiments of the invention, the kits of the present invention comprise a microarray. The microarray can be any of the microarrays described above, e.g., in Section 5.6.1, optionally in a sealed container. In one embodiment this microarray comprises a plurality of probe spots, wherein at least 20%, 40%, 60%, 80%, or 90% of the probe spots in the plurality of probe spots correspond to marker genes listed in Tables 1a and/or 1b or any one of Tables 2a and/or 2b and 4.

In still other embodiments, the kits of the invention may further comprise a computer program product for use in conjunction with a computer system, wherein the computer program product comprises a computer readable storage medium and a computer program mechanism embedded therein. In such kits, the computer program mechanism comprises instructions for prediction of prognosis using a marker profile obtained with the reagents of the kits.

In still other embodiments, the kits of the present invention comprise a computer having a central processing unit and a memory coupled to the central processing unit. The memory stores instructions for for prediction of prognosis using a marker profile obtained with the reagents of the kits.

5.10. Pharmaceutical Formulations and Routes of Administration

The compounds that can be used to modulate the expression of the CML progression genes or the activity of their gene products can be administered to a patient at therapeutically effective doses. A therapeutically effective dose refers to that amount of the compound sufficient to result in normal expression or activity level.

5.10.1. Effective Dose

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit large therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

5.10.2. Formulations and Use

Pharmaceutical compositions for use in accordance with the present invention may be formulated in conventional manner using one or more pharmaceutically acceptable carriers or excipients.

Thus, the compounds and their pharmaceutically acceptable salts and solvates may be formulated for administration by inhalation or insufflation (either through the mouth or the nose) or oral, buccal, parenteral or rectal administration.

For oral administration, the pharmaceutical compositions may take the form of, for example, tablets or capsules prepared by conventional means with pharmaceutically acceptable excipients such as binding agents (e.g., pregelatinised maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets may be coated by methods well known in the art. Liquid preparations for oral administration may take the form of, for example, solutions, syrups or suspensions, or they may be presented as a dry product for constitution with water or other suitable vehicle before use. Such liquid preparations may be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations may also contain buffer salts, flavoring, coloring and sweetening agents as appropriate.

Preparations for oral administration may be suitably formulated to give controlled release of the active compound.

For buccal administration the compositions may take the form of tablets or lozenges formulated in conventional manner.

For administration by inhalation, the compounds for use according to the present invention are conveniently delivered in the form of an aerosol spray presentation from pressurized packs or a nebuliser, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of e.g. gelatin for use in an inhaler or insufflator may be formulated containing a powder mix of the compound and a suitable powder base such as lactose or starch.

The compounds may be formulated for parenteral administration by injection, e.g., by bolus injection or continuous infusion. Formulations for injection may be presented in unit dosage form, e.g., in ampoules or in multi-dose containers, with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle, e.g., sterile pyrogen-free water, before use.

The compounds may also be formulated in rectal compositions such as suppositories or retention enemas, e.g., containing conventional suppository bases such as cocoa butter or other glycerides.

In addition to the formulations described previously, the compounds may also be formulated as a depot preparation. Such long acting formulations may be administered by implantation (for example subcutaneously or intramuscularly) or by intramuscular injection. Thus, for example, the compounds may be formulated with suitable polymeric or hydrophobic materials (for example as an emulsion in an acceptable oil) or ion exchange resins, or as sparingly soluble derivatives, for example, as a sparingly soluble salt.

The compositions may, if desired, be presented in a pack or dispenser device which may contain one or more unit dosage forms containing the active ingredient. The pack may for example comprise metal or plastic foil, such as a blister pack. The pack or dispenser device may be accompanied by instructions for administration.

5.10.3. Routes of Administration

Suitable routes of administration may, for example, include oral, rectal, transmucosal, transdermal, or intestinal administration; parenteral delivery, including intramuscular, subcutaneous, intramedullary injections, as well as intrathecal, direct intraventricular, intravenous, intraperitoneal, intranasal, or intraocular injections.

Alternately, one may administer the compound in a local rather than systemic manner, for example, via injection of the compound directly into an affected area, often in a depot or sustained release formulation.

Furthermore, one may administer the drug in a targeted drug delivery system, for example, in a liposome coated with an antibody specific for affected cells. The liposomes will be targeted to and taken up selectively by the cells.

5.10.4. Packaging

The compositions may, if desired, be presented in a pack or dispenser device which may contain one or more unit dosage forms containing the active ingredient. The pack may for example comprise metal or plastic foil, such as a blister pack. The pack or dispenser device may be accompanied by instructions for administration. Compositions comprising a compound formulated in a compatible pharmaceutical carrier may also be prepared, placed in an appropriate container, and labeled for treatment of an indicated condition. Suitable conditions indicated on the label may include treatment of a disease such as one characterized by aberrant or excessive expression or activity of a CML progression protein.

5.10.5. Combination Therapy

In a combination therapy, one or more compositions of the present invention can be administered before, at the same time as, or after the administration of a chemotherapeutic agent. In one embodiment, the compositions of the invention are administered before the administration of an chemotherapeutic agent (i.e., the agent that modulates expression or activity of a CML progression gene or imatinib mesylate resistance gene and/or encoded protein is for sequential or concurrent use with one or more chemotherapeutic agents). In one embodiment, the composition of the invention and a chemotherapeutic agent are administered in a sequence and within a time interval such that the composition of the invention and a chemotherapeutic agent can act together to provide an increased benefit than if they were administered alone. In another embodiment, the composition of the invention and a chemotherapeutic agent are administered sufficiently close in time so as to provide the desired therapeutic outcome. The time intervals between the administration of the compositions of the invention and a chemotherapeutic agent can be determined by routine experiments that are familiar to one skilled person in the art. In one embodiment, a chemotherapeutic agent is given to the patient after the level of the CML progression gene or imatinib mesylate resistance gene and/or encoded protein reaches a desirable threshold. The level of a CML progression gene or imatinib mesylate resistance gene and/or encoded protein can be determined by using any techniques known in the art such as those described in Section 5.3., infra.

The composition of the invention and a chemotherapeutic agent can be administered simultaneously or separately, in any appropriate form and by any suitable route. In one embodiment, the composition of the invention and the chemotherapeutic agent are administered by different routes of administration. In an alternate embodiment, each is administered by the same route of administration. The composition of the invention and the chemotherapeutic agent can be administered at the same or different sites, e.g. arm and leg.

In various embodiments, such as those described above, the composition of the invention and a chemotherapeutic agent are administered less than 1 hour apart, at about 1 hour apart, 1 hour to 2 hours apart, 2 hours to 3 hours apart, 3 hours to 4 hours apart, 4 hours to 5 hours apart, 5 hours to 6 hours apart, 6 hours to 7 hours apart, 7 hours to 8 hours apart, 8 hours to 9 hours apart, 9 hours to 10 hours apart, 10 hours to 11 hours apart, 11 hours to 12 hours apart, no more than 24 hours apart or no more than 48 hours apart, or no more than 1 week or 2 weeks or 1 month or 3 months apart. As used herein, the word about means within 10%. In other embodiments, the composition of the invention and a chemotherapeutic agent are administered 2 to 4 days apart, 4 to 6 days apart, 1 week apart, 1 to 2 weeks apart, 2 to 4 weeks apart, one month apart, 1 to 2 months apart, or 2 or more months apart. In preferred embodiments, the composition of the invention and a chemotherapeutic agent are administered in a time frame where both are still active. One skilled in the art would be able to determine such a time frame by determining the half life of each administered component. In separate or in the foregoing embodiments, the composition of the invention and a chemotherapeutic agent are administered less than 2 weeks, one month, six months, 1 year or 5 years apart.

In another embodiment, the compositions of the invention are administered at the same time or at the same patient visit, as the chemotherapeutic agent.

In still another embodiment, one or more of the compositions of the invention are administered both before and after the administration of a chemotherapeutic agent. Such administration can be beneficial especially when the chemotherapeutic agent has a longer half life than that of the one or more of the composition of the invention used in the treatment.

In one embodiment, the chemotherapeutic agent is administered daily and the composition of the invention is administered once a week for the first 4 weeks, and then once every other week thereafter. In one embodiment, the chemotherapeutic agent is administered daily and the composition of the invention is administered once a week for the first 8 weeks, and then once every other week thereafter.

In certain embodiments, the composition of the invention and the chemotherapeutic agent are cyclically administered to a subject. Cycling therapy involves the administration of the composition of the invention for a period of time, followed by the administration of a chemotherapeutic agent for a period of time and repeating this sequential administration. Cycling therapy can reduce the development of resistance to one or more of the therapies, avoid or reduce the side effects of one of the therapies, and/or improve the efficacy of the treatment. In such embodiments, the invention contemplates the alternating administration of the composition of the invention followed by the administration of a chemotherapeutic agent 4 to 6 days later, preferable 2 to 4 days, later, more preferably 1 to 2 days later, wherein such a cycle may be repeated as many times as desired.

In certain embodiments, the composition of the invention and a chemotherapeutic agent are alternately administered in a cycle of less than 3 weeks, once every two weeks, once every 10 days or once every week. In a specific embodiment of the invention, one cycle can comprise the administration of a chemotherapeutic agent by infusion over 90 minutes every cycle, 1 hour every cycle, or 45 minutes every cycle. Each cycle can comprise at least 1 week of rest, at least 2 weeks of rest, at least 3 weeks of rest. In an embodiment, the number of cycles administered is from 1 to 12 cycles, more typically from 2 to 10 cycles, and more typically from 2 to 8 cycles.

It will be apparent to one skilled person in the art that any combination of different timing of the administration of the compositions of the invention and a chemotherapeutic agent can be used. For example, when the chemotherapeutic agent has a longer half life than that of the composition of the invention, it is preferable to administer the compositions of the invention before and after the administration of the chemotherapeutic agent.

The frequency or intervals of administration of the compositions of the invention depends on the desired level of the CML progression gene or imatinib mesylate resistance gene and/or encoded protein, which can be determined by any of the techniques known in the art, e.g., those techniques described infra. The administration frequency of the compositions of the invention can be increased or decreased when the level of the CML progression gene or imatinib mesylate resistance gene and/or encoded protein changes either higher or lower from the desired level.

5.11. Implementation Systems and Methods

The analytical methods of the present invention can preferably be implemented using a computer system, such as the computer system described in this section, according to the following programs and methods. Such a computer system can also preferably store and manipulate measured signals obtained in various experiments that can be used by a computer system implemented with the analytical methods of this invention. Accordingly, such computer systems are also considered part of the present invention.

An exemplary computer system suitable from implementing the analytic methods of this invention is illustrated in FIG. 8. Computer system 801 is illustrated here as comprising internal components and as being linked to external components. The internal components of this computer system include one or more processor elements 802 interconnected with a main memory 803. For example, computer system 801 can be an Intel Pentium IV®-based processor of 2 GHZ or greater clock rate and with 256 MB or more main memory. In a preferred embodiment, computer system 801 is a cluster of a plurality of computers comprising a head "node" and eight sibling "nodes," with each node having a central processing unit ("CPU"). In addition, the cluster also comprises at least 128 MB of random access memory ("RAM") on the head node and at least 256 MB of RAM on each of the eight sibling nodes. Therefore, the computer systems of the present invention are not limited to those consisting of a single memory unit or a single processor unit.

The external components can include a mass storage 804. This mass storage can be one or more hard disks that are typically packaged together with the processor and memory. Such hard disk are typically of 10 GB or greater storage capacity and more preferably have at least 40 GB of storage capacity. For example, in a preferred embodiment, described above, wherein a computer system of the invention comprises several nodes, each node can have its own hard drive. The head node preferably has a hard drive with at least 10 GB of storage capacity whereas each sibling node preferably has a hard drive with at least 40 GB of storage capacity. A computer system of the invention can further comprise other mass storage units including, for example, one or more floppy drives, one more CD-ROM drives, one or more DVD drives or one or more DAT drives.

Other external components typically include a user interface device 805, which is most typically a monitor and a keyboard together with a graphical input device 806 such as a "mouse." The computer system is also typically linked to a network link 807 which can be, e.g., part of a local area network ("LAN") to other, local computer systems and/or part of a wide area network ("WAN"), such as the Internet, that is connected to other, remote computer systems. For example, in the preferred embodiment, discussed above, wherein the computer system comprises a plurality of nodes, each node is preferably connected to a network, preferably an NFS network, so that the nodes of the computer system communicate with each other and, optionally, with other computer systems by means of the network and can thereby share data and processing tasks with one another.

Loaded into memory during operation of such a computer system are several software components that are also shown schematically in FIG. 8. The software components comprise both software components that are standard in the art and components that are special to the present invention. These software components are typically stored on mass storage such as the hard drive 804, but can be stored on other computer readable media as well including, for example, one or more floppy disks, one or more CD-ROMs, one or more DVDs or one or more DATs. Software component 810 represents an operating system which is responsible for managing the computer system and its network interconnections. The operating system can be, for example, of the Microsoft Windows™ family such as Windows 95, Window 98, Windows NT, Windows 2000 or Windows XP. Alternatively, the operating software can be a Macintosh operating system, a UNIX operating system or a LINUX operating system. Software components 811 comprises common languages and functions that are preferably present in the system to assist programs implementing methods specific to the present invention. Languages that can be used to program the analytic methods of the invention include, for example, C and C++, FORTRAN, PERL, HTML, JAVA, and any of the UNIX or LINUX shell command languages such as C shell script language. The methods of the invention can also be programmed or modeled in mathematical software packages that allow symbolic entry of equations and high-level specification of processing, including specific algorithms to be used, thereby freeing a user of the need to procedurally program individual equations and algorithms. Such packages include, e.g., Matlab from Mathworks (Natick, Mass.), Mathematica from Wolfram Research (Champaign, Ill.) or S-Plus from MathSoft (Seattle, Wash.).

Software component 812 comprises any analytic methods of the present invention described supra, preferably programmed in a procedural language or symbolic package. For example, software component 812 preferably includes programs that cause the processor to implement steps of accepting a plurality of measured signals and storing the measured signals in the memory. For example, the computer system can accept measured signals that are manually entered by a user (e.g., by means of the user interface). More preferably, however, the programs cause the computer system to retrieve measured signals from a database. Such a database can be stored on a mass storage (e.g., a hard drive) or other computer readable medium and loaded into the memory of the computer, or the compendium can be accessed by the computer system by means of the network 807.

In addition to the exemplary program structures and computer systems described herein, other, alternative program structures and computer systems will be readily apparent to the skilled artisan. Such alternative systems, which do not depart from the above described computer system and programs structures either in spirit or in scope, are therefore intended to be comprehended within the accompanying claims.

6. EXAMPLES

The following examples are presented by way of illustration of the present invention, and are not intended to limit the present invention in any way.

6.1. Identification of Phase-Specific Genes in CML

A set of 91 individual cases of CML, including chronic phase (N=42), accelerated phase by blast count criteria (N=9) or by the occurrence of additional clonal cytogenetic changes (N=8), blast crisis (N=28), and 4 cases of blast crisis in remission after chemotherapy were used to identify genes involved in progression from chronic phase to advanced disease (i.e., accelerated and blast phases). A pool of 200 chronic phase bone marrows was used as the reference. An ANOVA analysis revealed ~3,000 genes differentially expressed across the different phases of disease using a minimum statistical significance cutoff of $p<10^{-11}$ (Tables 1a and 1b). Sequences of polynucleotide probes used to detect these genes are listed in Table 8. This set of genes identified in the progression from chronic to blast phase is referred to here as the "phase reporter" gene set. FIG. 1 shows a "heat map" of the expression of the 3,000 phase reporter genes across the various phases of CML. This illustrates the global change of gene expression as the disease progresses from the chronic phase through the advanced phase of the disease.

The expression patterns were then examined to determine if progression of CML best fits a three-step model as often described in the literature (chronic phase to accelerated phase to blast crisis), or a two-step model (chronic phase to advanced phase, i.e., accelerated or blast phase). The gene expression patterns of accelerated phase cases were compared to those of the blast crisis cases (FIG. 5). The correlation between the expression profiles of accelerated cases and those of the blast phase was quite strong (r=0.81). Comparing differentially regulated genes between accelerated phase with blast phase, there are very few phase specific genes, i.e. genes only regulated in one phase but not in another. These observations suggest that the difference of gene expression changes between accelerated and blast phase is a quantitative one rather than a qualitative one that requires new gene expression or repression.

The biological functions of the genes associated with CML phases were also examined by applying a biological annotation program based on the GO and KEGG annotations. The functional groups most highly correlated with progression to blast crisis included increased expression of nuclear genes, mitochondrial genes, RNA binding genes, protein biosynthesis genes, and genes involved in chaperone function, all reflecting the increased proliferation and metabolism of progressive disease.

Progression was also associated with decreases in the expression levels of genes involved in structural integrity and adhesion, as well as decreases in the expression levels of genes involved in inflammatory and immune response. In addition, several proto-oncogenes and tumor suppressor genes were differentially expressed with progression. For example, N- and Hras, FLT3, yes, AF1q, CBFB, WT1, ORALOV1, PTNN11, and Bcl-2 demonstrated increased expression in blast crisis as compared to chronic phase. Analysis of the phase reporter genes suggested a relative decrease in MAPPK signaling in advanced phase as compared to chronic phase. The progression was also seen as associated with increases in alternative signal pathways. Thus, the cytoplasmic GTP protein Rras2 was highly overexpressed in advanced phases, as was ras signaling components RAB56 and RALGD5. Alterations of cytokine signaling were demonstrated by an increase in expression of TNF factors SF4 and 7, and SOCS2 and 4.

6.2. Identification of Progression- and Response-Specific Genes

Figure 2A:
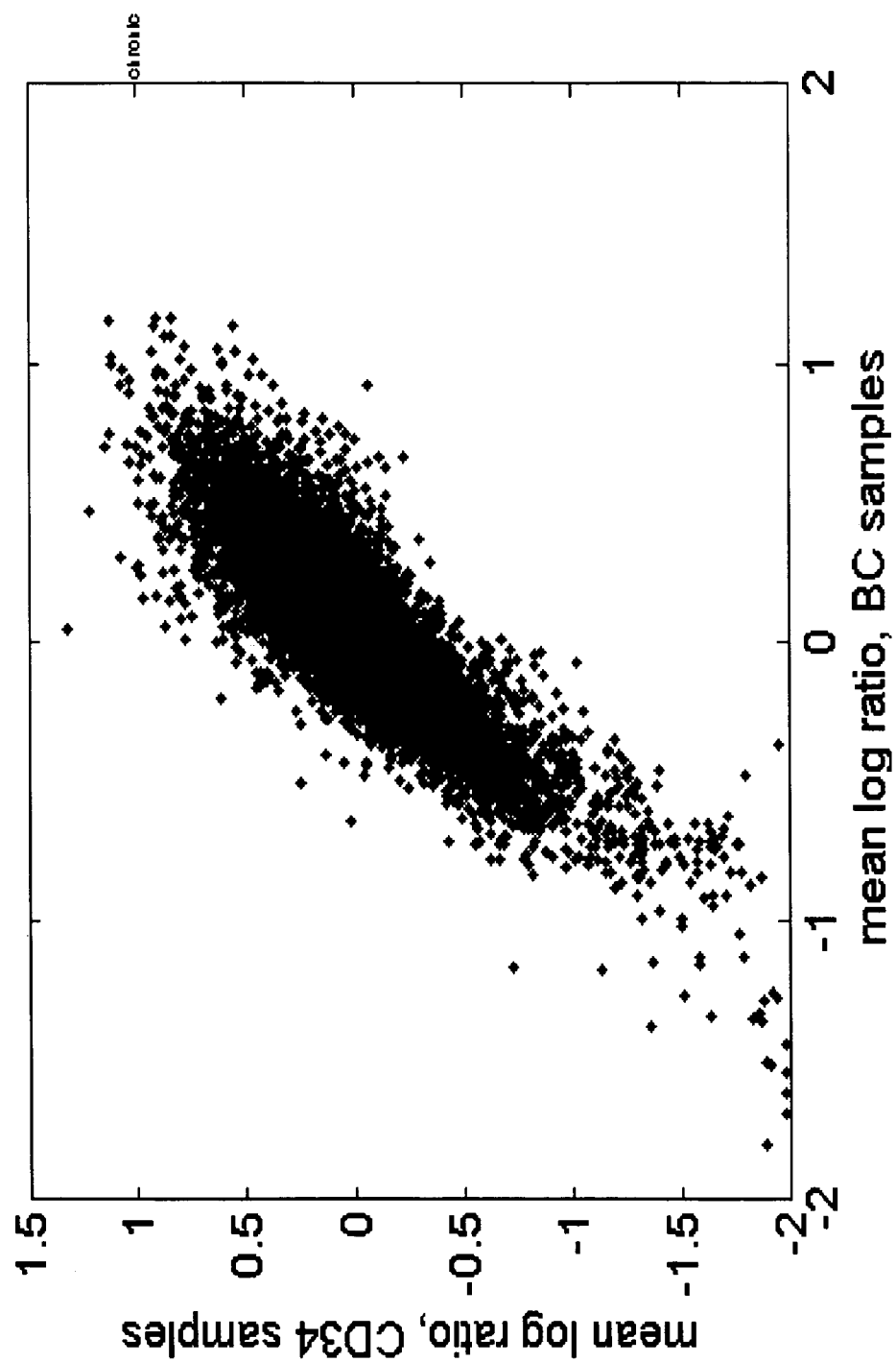
Figure 2B:
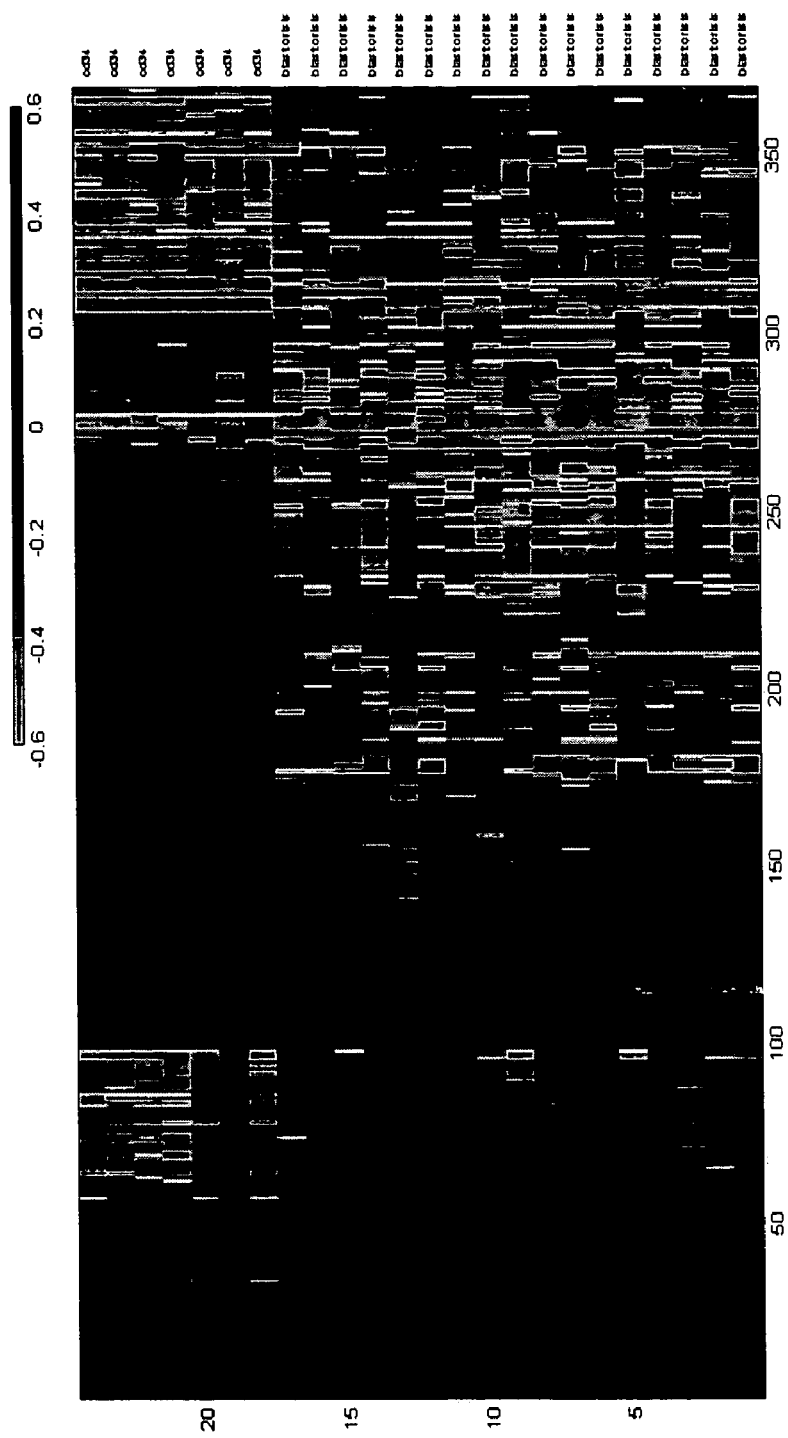
Figure 2C:
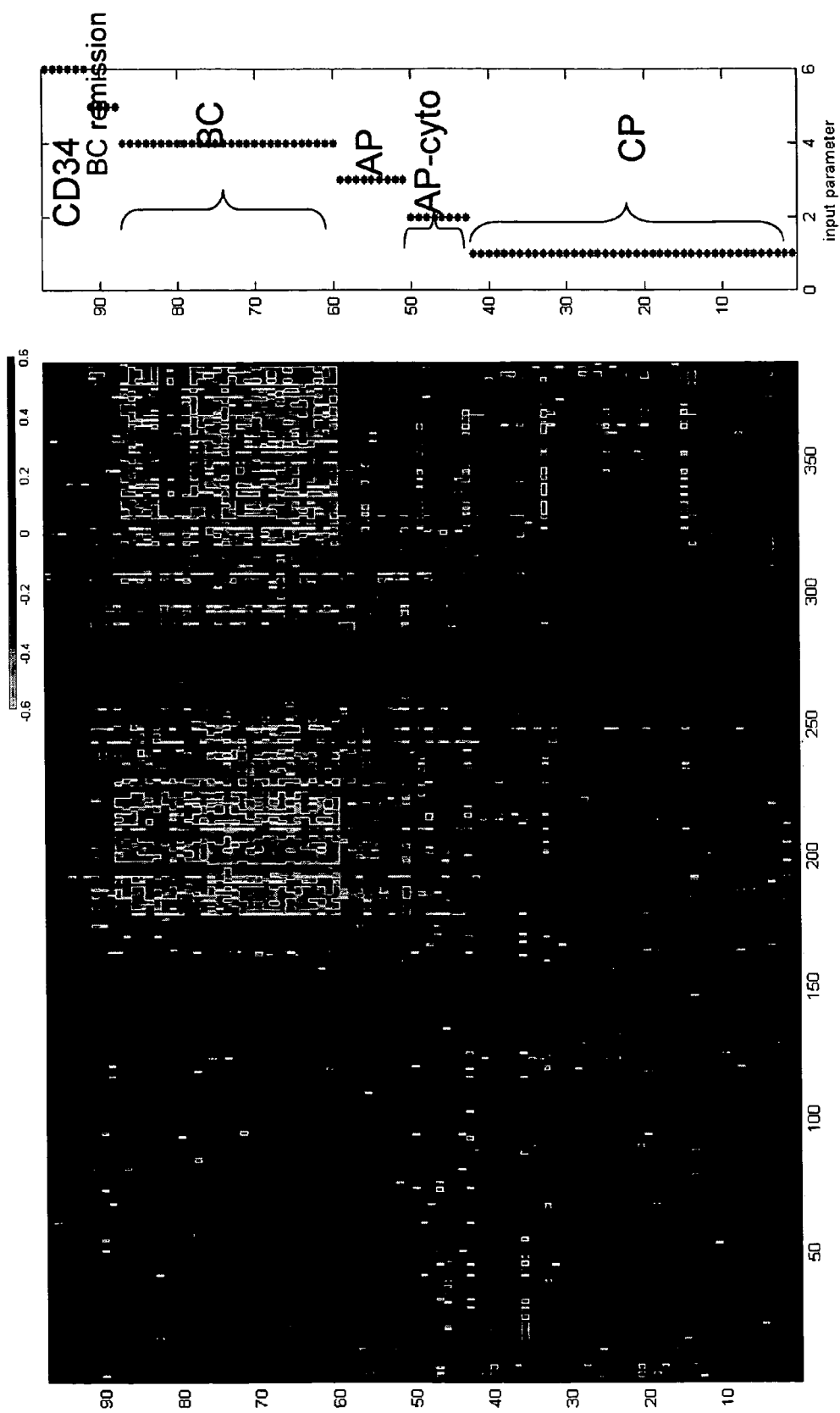

Next, how the phase reporter gene set was influenced by the gene expression signature of leukemia blasts and how they compared to normal immature CD34+ cells were investigated. First, the gene expression signatures of eight samples of normal CD34+ cells were compared with CML blast samples containing >70% blasts (FIG. 2a). It was found that the gene expression pattern of CML blast cells was very similar to normal CD34+ cells, suggesting that "progression" from the chronic phase to the advanced phase is functionally similar to a block or "reversion" towards a more primitive hematopoetic cell. To uncover genes that are unique to progression, the normal CD34+ signatures were mathematically subtracted from each of the disease samples and the phase reporter signals were searched for (FIG. 2c and FIG. 6). A set of 386 genes ($p<10^{-8}$) were identified (FIG. 2c and Tables 2a and 2b). These genes are called the "progression genes." A set of 368 genes with ANOVA p<0.1% were identified as differentially expressed between CML blast crisis and normal immature CD34+ cells were also identified (FIG. 2b and Tables 5a and 5b). These genes are called the "target genes." There were 103 genes overlapping between these two sets (hypergeometric P-value: $1.3\times10^{-99}$). This gene set is enriched in genes that are diagnostic markers of progression and novel targets of therapy. Table 3 shows the "top ten" genes that are associated with progression, independent of normal CD34+ expression, based on log 10 ratio of expression compared to the chronic phase pool. These genes suggest a deregulation of genes of transcriptional regulation (GLI2, WT1, FOS, FOSB), signal transduction (SOCS2, Rras2, IL8), and apoptosis (GAS2). Moreover, two HSP 70 subunits are differentially down-regulated, suggesting an alteration of this component of the chaperone system in blast crisis. Also significantly associated with progression was the surface protein PRAME, which has an unknown function, but has been associated with myeloid malignancy (van Baren et al. 1998, Br J Haematol 102:1376; Watari et al. 2000, FEBS Lett 466:

367). Gene functions overrepresented in blast crisis were predominated by changes in ribosome gene expression and increased in the beta-catenin/WNT signaling pathway. More significant changes in gene function were down-regulated in progression, including nucleosome assembly and chromatin structure, sugar catabolism and metabolism, differentiation, and apoptosis.

6.3. Identification of Signaling Pathways Associated with Progression

Multiple changes in several signaling pathways are represented in the progression gene set. Again, these genes were seen in the progression of chronic phase to advanced disease, but are differentially expressed compared to normal CD34+ cells. There was a deregulation of the betacatenin/WNT pathway. Expression of the cell surface protein cadherin was decreased, as was proto-cadhedrin, potentially leading to an activation of the beta-catenin/WNT signaling pathway by allowing more free beta-catenin to move to the cytoplasm. Moreover, the myogenesis transcription control gene MDFI (I-mfa), which complexes with axin (therefore potentially increasing free beta-catenin), was increased by approximately 7-fold. In all, 16 genes associated with the beta-catenin pathway were significantly over-expressed (e.g., PRICKLE1, CSNK1E, PLCB1, FZD2, LRP6, SMAD3, etc.). In summary, these findings strongly suggest aberrant activation of the betacatenin/WNT pathway during CML progression. Moreover, progression appears to be associated with a remodeling of several cytoskeletal and adhesion molecules, which may play a role in regulating proliferation. Thus there is an increase in CD47, Crebl1, and ITGA5 expression, and a decrease in proto-cadhedrin, cadhedrin, actin, and betaactin.

In addition, the abl family member abl2 (ARG) was significantly associated with disease progression; by contrast, abl1, which is both expressed from the normal chromosome 9 and the t(9;22) translocation, was not differentially expressed with progression. Advanced phase disease was associated with deregulation of transcription factors, differentiation and apoptosis. Both components of the AP-1 transcription complex, Jun B and Fos, show decreased expression in progression. In addition, the Kupple-like zinc finger GLI2 is highly over-expressed in progression. The block in differentiation may be facilitated by the up-regulation of MDFI, WT1, and AF1q, and the down regulation of GADD45. Apoptosis in blast cells appears to be inhibited by the over-expression of Bcl2, DAP, and the decrease in MCL1 and Acinus. Progression was also associated with alterations in normal protein chaperone and degradation processes, with a widespread decrease in the expression of HSP70 and DNAJ families of genes. In addition, proteosome components BMA1 PSME2, and TRIP12 were all significantly increased in advanced phase CML cases.

6.4. Identification of Progression-Specific Promoters

In order to examine if specific pathways were altered in progression, the progression and phase reporter gene sets were analyzed for aberrant expression of genes possessing known promoter sequences. Aberrant regulation of several sets of promoter controlled genes was revealed (Table 6). The most statistically significantly set of genes showing aberrant control in progression where those that contained a MZF promoter or a delta EF1 promoter sequence ($p<10^{-15}$ and $<10^{-11}$, respectively; FIGS. 3a and 3b). Also significantly associated with progression were genes bearing SPI-B, Yin Yang, and Ahr-ARNT promoter sequences (all with p values $<10^{-9}$).

6.5. Identification of Imatinib Responsiveness Reporter Genes

Gene expression profiles of patients who failed imatinib therapy were analyzed. A set of 21 cases of CML treated with the tyrosine kinase inhibitor imatinib mesylate, including 9 patients who initially achieved a complete cytogenetic remission (CCR) on imatinib therapy, but then relapsed, most back into an apparent chronic phase by morphology; 3 cases who had achieved a complete hematologic but no cytogenetic response; 3 late chronic phase patients before treatment with imatinib; and 6 cases of blast crisis was used. All but one of these the chronic phase patients who relapsed after a CCR had a point mutation in abl1, presumably abrogating imatinib activity (Table 7).

TABLE 7

Characteristics of cases treated with imatinib

| CODE | Case type | Phase of Disease at initiation of imatinib | Phase of disease at time of sample | Cytogenetics | Mutation(s) |
|---|---|---|---|---|---|
| 2 | Imatinib failure | chronic | relapsed chronic | 100% Ph+; NEW: t(1; 12) in all cells | M244V |
| 4 | Imatinib failure | chronic | relapsed chronic | 100% Ph+ | T315I |
| 5 | Imatinib failure | chronic | relapsed chronic | 80% Ph+ | F359V |
| 6 | Imatinib failure | chronic | relapsed chronic | 100% Ph+ | M351T, F317L |
| 8 | Imatinib failure | chronic | relapsed chronic | 100% Ph+ | M351T |
| 10 | Imatinib failure | chronic | relapsed chronic | 100% Ph+ | E255K |
| 11 | Imatinib failure | chronic post-allo BMT | relapsed chronic | not available | T315I |
| 12 | Imatinib failure | chronic | relapsed chronic | 100% Ph+ | L248V |
| 14 | Imatinib failure | chronic | relapsed chronic | 100% Ph+ | M351T, H396R |
| 15 | Pre-imatinib treatment | chronic | chronic pre-treatment | 50% Ph+ | none |
| 17 | Pre-imatinib treatment | chronic | chronic pre-treatment | 100% Ph+ | none |
| 18 | Pre-imatinib treatment | chronic | CHR; no cytogenetic response | 100% Ph+ | none |
| 19 | Pre-imatinib treatment | chronic | chronic pre-treatment | 45% t(9; 13; 22); 50% t (9; 13; 22), −Y; 5% nl | none |

TABLE 7-continued

Characteristics of cases treated with imatinib

| CODE | Case type | Phase of Disease at initiation of imatinib | Phase of disease at time of sample | Cytogenetics | Mutation(s) |
|---|---|---|---|---|---|
| 21 | Pre-imatinib treatment | chronic | CHR; no cytogenetic response | 100% Ph+ | none |
| 22 (same pt as 13) | Pre-imatinib treatment | chronic | CHR; no cytogenetic response | 100% Ph+ (3 of 18 with additional Ph) | none |
| 23 | Pre-imatinib treatment | myeloid blast crisis | pre-treatment MBC | 100% Ph+ | none |
| 24 | Pre-imatinib treatment | myeloid blast crisis | pre-treatment MBC | 100% Ph+, t(2; 16) | none |
| 25 | Pre-imatinib treatment | myeloid blast crisis | pre-treatment MBC | 100% Ph+, +8, iso 17q | none |
| 26 | Pre-imatinib treatment | myeloid blast crisis | not treated | not available | unknown |
| 27 | Pre-imatinib treatment | myeloid blast crisis | relapsed MBC | 100% Ph+ | unknown |
| 29 | Pre-imatinib treatment | myeloid blast crisis | relapsed MBC | not available | unknown |
| 29 | Pre-imatinib treatment | myeloid blast crisis | relapsed MBC | not available | unknown |

Figure 4A:
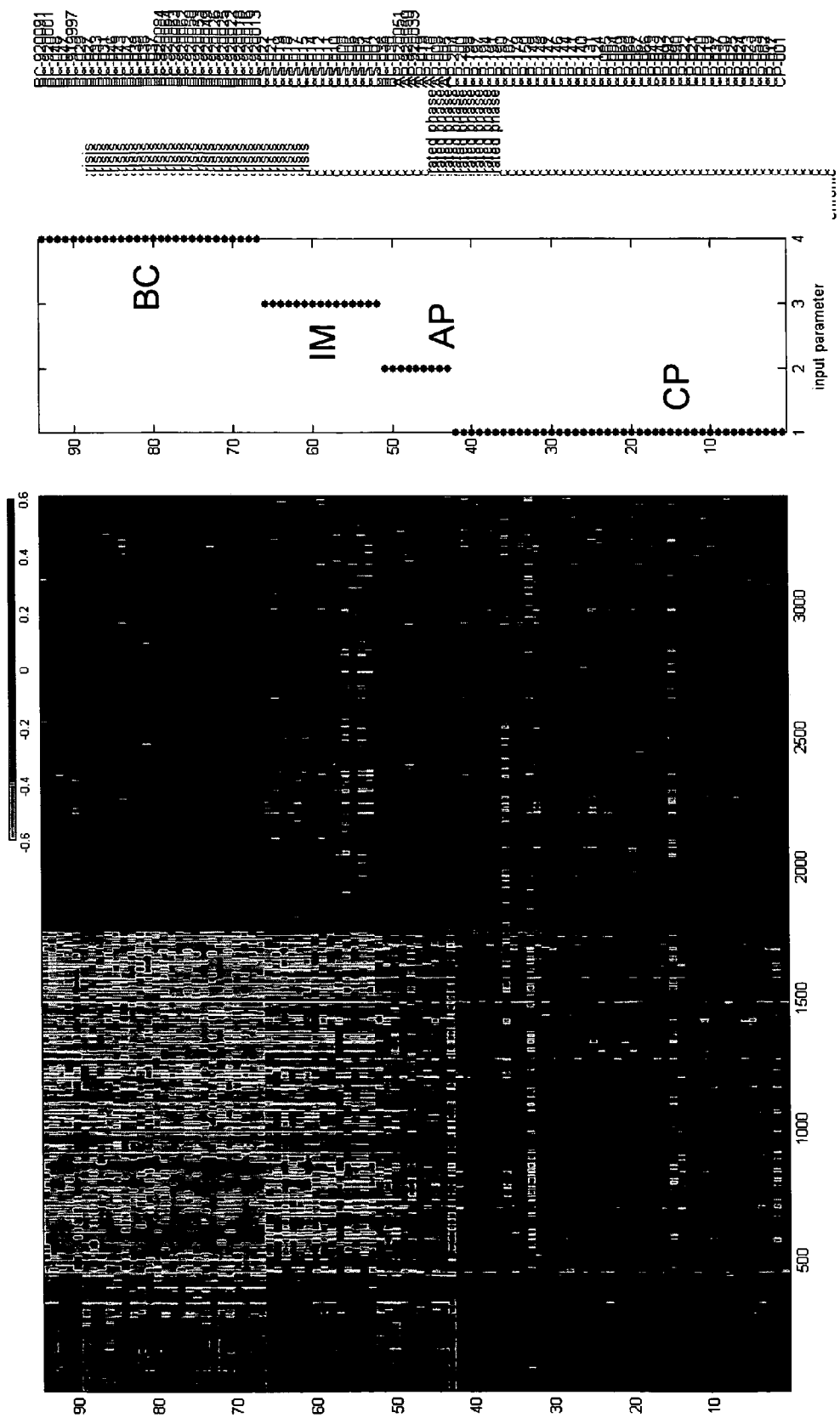
Figure 4B:
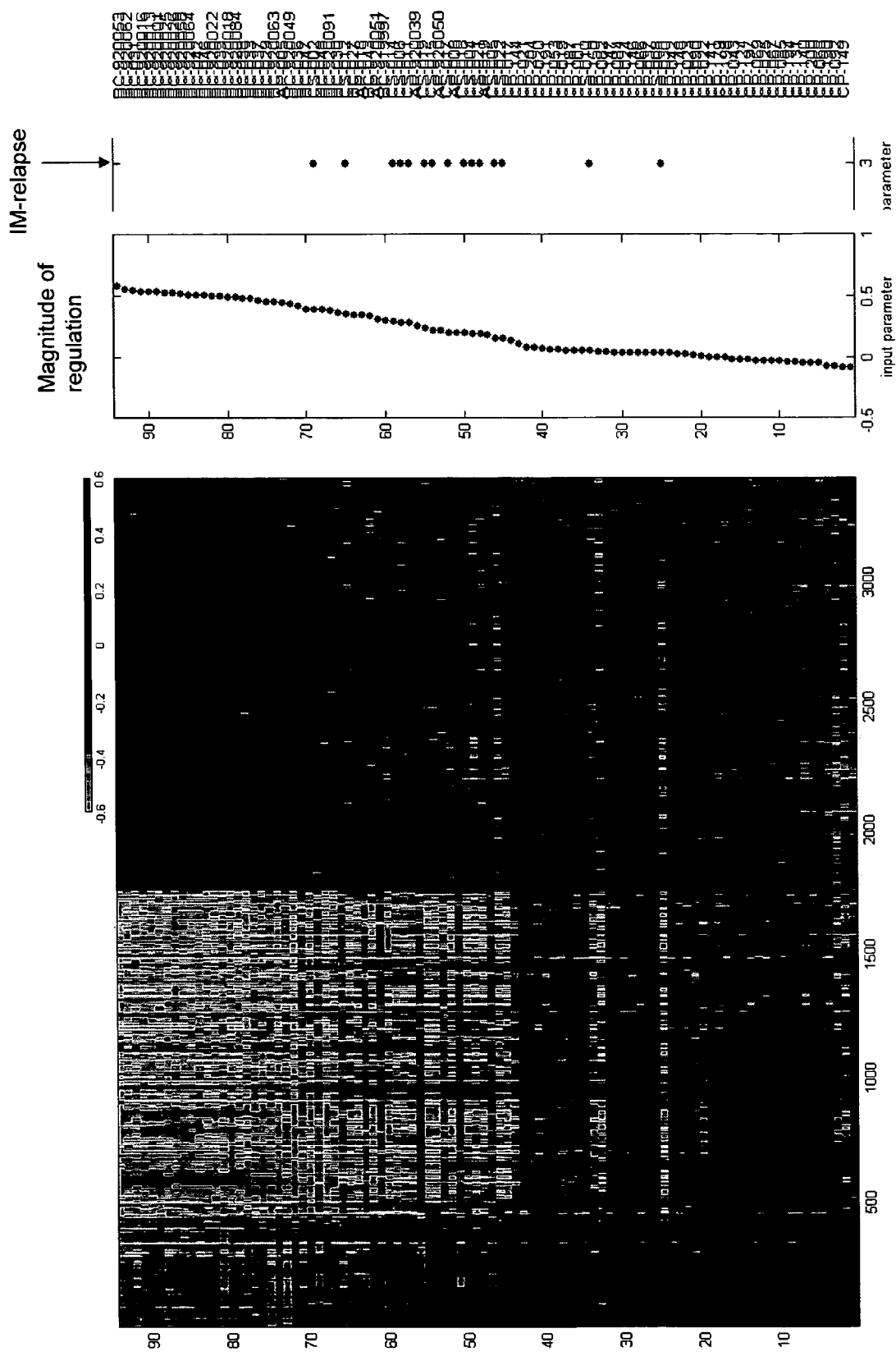
Figure 4C:
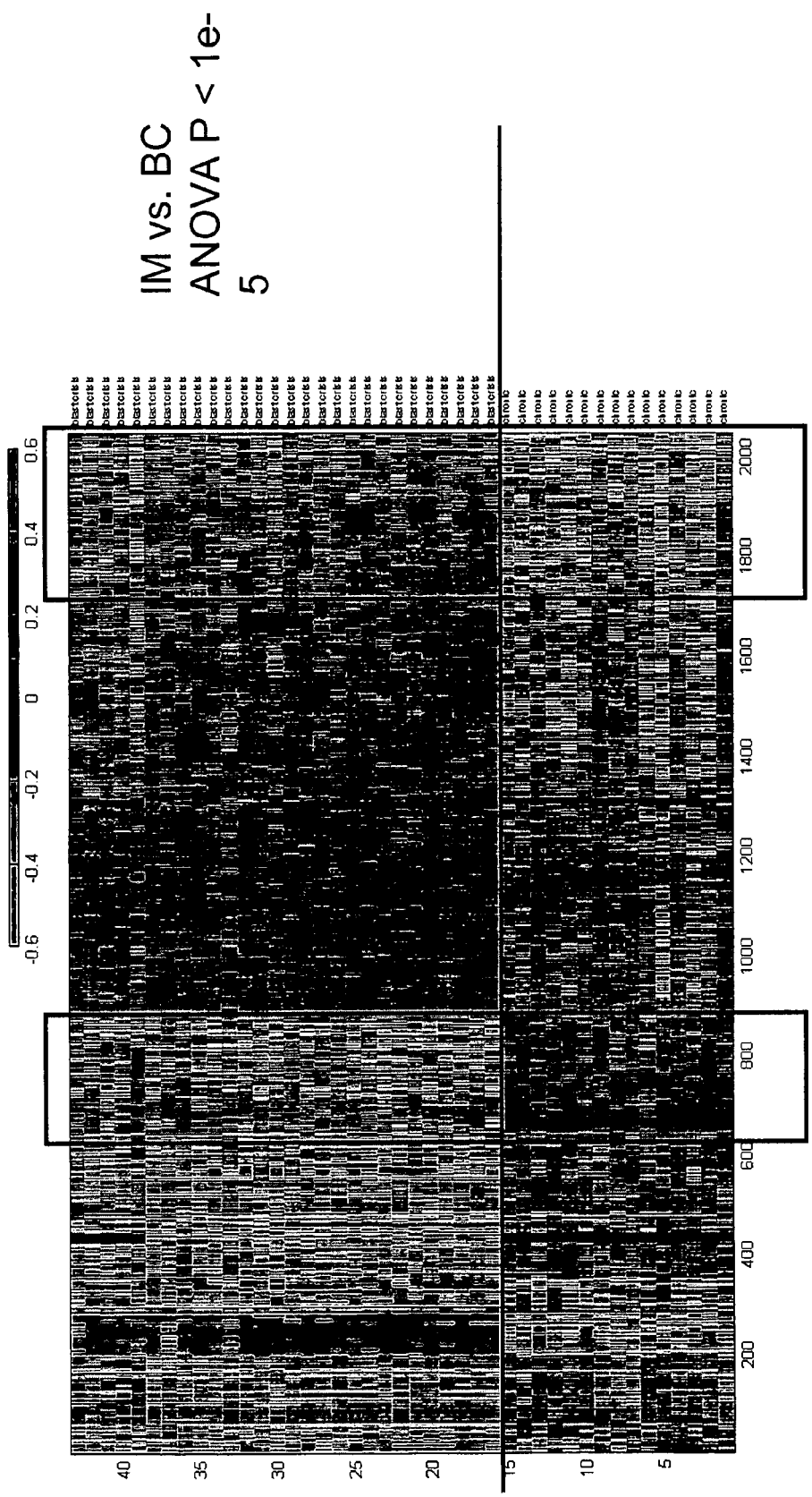

FIG. 4a shows the expression pattern of 15 cases of clinical chronic phase CML patients, 3 with longstanding chronic phase before imatinib treatment, the other 12 who had initially a suboptimal response (achieving only a hematological response) or relapsed after an initial CCR. The association with the progression signature can be demonstrated by segregating all CML cases by the correlation of gene expression signature between the boundaries of "most chronic" and "most advanced" gene expression for all 3,000 genes in the phase reporter gene set (FIG. 4b). The majority of the poor response patients had gene expression profiles more consistent with advanced disease rather than chronic phase. Both cases with T315I mutations, which have been shown to have especially poor prognosis, have expression signatures more similar to advanced disease than chronic phase. However, while these imatinib failures shared much of the blast crisis signature, there were gene expression features that were unique to these cases. FIG. 4c compares relapsed imatinib cases against blast crisis cases. Several areas (boxed) indicate genes that are expressed in reverse direction in these two states. Table 4 lists genes in the first box which are strongly associated with imatinib failure. Examples of genes unique to imatinib failure are those of serine threonine kinases (CTRL, MAP21K14, CLK3), MAP kinase (MKNK2), and the tyrosine kinase oncogene FYN. The highest genes over-expressed in imatinib resistant cases were TCF7 (a putatively T cell specific transcription factor), two guanine nucleotide binding proteins (GNAZ and GNG11), and the MAF oncogene.

6.6. Discussion

The biology and treatment of CML is dictated by the phase of disease, since the efficacy of all therapies (transplantation, interferon, imatinib) works best in chronic phase, and worse in accelerated phase and blast crisis. Understanding the biology of progression provides clinical diagnostic markers of progression, and offer insights into new strategies for treatment. The data presented in these examples suggest that the progression of chronic phase CML to advanced phase CML is a two-step process, with progression associated with a block of differentiation and apoptosis, a shift towards turning on expression of genes involved in the nucleosome, while down-regulating histone transcription. Moreover, progression is associated with alterations in cell adhesion, and activation of alternative signaling pathways. In addition, it appears that relapse after initial successful treatment with imatinib may be associated with gene expression patterns similar to advanced phase CML, suggesting that the process of progression persists in a subpopulation of CML cells even in the background of apparent successful therapy.

The demonstration that the gene expression pattern between accelerated and blast phases are very similar suggests that the crucial steps in progression are at the transition of chronic to accelerated phase, before obvious morphologic, cytogenetic or clinical evidence of progression. This has obvious clinical implications, since these patients might benefit from aggressive therapy. In addition, the observation that gene signatures of blast crisis can be seen in accelerated phase patients by cytogenetic criteria only, and blast crisis cases in remission (both of which have low blast counts similar to patients with chronic phase disease), demonstrates two important points. First, it points out the difficulty of correlating morphology with the biology of the disease.

Secondly, the penetration of a progression gene expression signature into a "chronic phase" appearing bone marrow suggests that progression is not merely an absolute block of differentiation, but that abnormal gene expression signals "leak" from the presumably immature blast crisis precursors into more normal appearing differentiated cell. This is critically important since it provides the basis for testing for progression genes in unsorted bone marrow samples from "chronic phase" patients.

In addition, the finding that CML blasts share a gene expression profile with normal CD34+ cells has important biological considerations (Passegue et al., 2003, Proc Natl Acad Sci USA 100 Suppl 1:11842). First, it implies that there may be a limited number of novel pathways active in CML blasts. This finding is obviously important (and encouraging) in the era of targeted therapeutics. It also may explain the relative resistance of blast crisis CML to chemotherapy. Normal hematopoetic stem cells are remarkably resistant to chemotherapy, and thus in AML and ALL, with remission comes the return of normal hematopoesis. Remission is rare in blast crisis CML, perhaps because the blast cells are similarly resistant to chemotherapy as their normal counterpart.

Bcr-Abl has a wholesale range of biological activities. Critical in the transformation process is the activation of the Ras/MAPK pathways, which has broad effects on changes in cell adhesion (through Rho), proliferation (MAPK pathway), and apoptosis (through Akt) (Faderl et al., 1999, N Engl J Med 341:164; Ren, 2002, Oncogene 21:8629). The efficacy of imatinib works through the blockade of these effects.

Imatinib works poorly on advanced phase disease, and it may be because these tumors are less reliant on the pathways that imatinib blocks than chronic phase disease. Thus, it was found that the MAPK pathway was relatively under-expressed in advanced disease compared to chronic phase, but other signaling pathways, including those involving cytokines (IL3RA, SOCS2), alternative ras pathways (Rras2), and those involved in cell adhesion (B-catenin/WNT) were activated. The activation of these pathways may allow progression even in the face of therapeutic blockade of Bcr-Abl activated pathways. In addition, abl2 (Abl related gene, or ARG) is also upregulated in progresson. As opposed to abl1 (which is a nuclear protein until involved in the chimeric Bcr-Abl protein, at which time it migrates to the cytoplasm), ARG is a cytoplasmic protein (Kruh et al., 1990, Proc Natl Acad Sci USA 87:5802). The signaling targets of ARG are unknown, and although broadly expressed in tissue, its only known functional role apparent from knockout mouse models appears to be in the nervous system (Koleske et al., 1998, Neuron 21:1259; Perego et al., 1991, Oncogene 6:1899). ARG has been associated with myeloid leukemia in the contest of TEL/ARG translocations (Cazzaniga et al., 1999, Blood 94:4370; Iijima et al., 2000, Blood 95:2126). ARG shares over 90% homology of its tyrosine kinase domain with abl1, and ARG tyrosine kinase activity is inhibited by imatinib at similar drug concentrations (Kruh et al., 1990, Proc Natl Acad Sci USA 87:5802; Okuda et al., 2001, Blood 97:2440). However, given that Bcr-ABL amplification is considered to play a role in imatinib resistance (le Coutre et al. 2000, Blood 95:1758; Weisberg et al., 2000, Blood 95:3498), ARG over-expression in blast crisis could theoretically contribute to the relative resistance to imatinib found with progressive disease.

Two recent observations on the molecular biology of progression in CML are relevant to this study. First, activation of the beta-catenin pathway was observed in primary cell samples from patients with CML (Jamieson et al., 2004, N Engl J Med 351:657). Secondly, it was recently observed that mice deficient in Jun B develop a disease much like CML (Passegue et al., 2004, Cell 119:431). The data in these examples complement these findings, as we found broad dysregulation of WNT/beta-catenin pathway as well as decreased Jun B expression. A link between these pathways may be the gene MDFI (Imfa), an inhibitor of myogenic basic H-L-H transcription factors 4. MDFI interacts with axin, which is involved in binding and modulating free beta-catenin. Thus an increase in MDFI would effectively allow for more free beta-catenin to migrate to the nucleus, where it causes gene activation (Nelson et al., 2004, Science 303: 1483). An increase in MDFI could also decrease the axinmediated activation of Jun (Kusano et al., 2002, Mol Cell Biol 22:6393). Thus, MDFI may play a central role in progression by both influencing the beta-catenin and Jun B pathways. Moreover, the fact that both Jun B and Fos were downregulated in progression suggests that there may be a wholesale deregulation of AP-1 targets, which could have broad functional affects on differentiation, apoptosis, and cell cycle control (Hess et al., 2004, J Cell Sci 117:5965).

The analysis suggests that genes controlled by MZF1 and delta EF1 may be particularly important in progression. MZF1 is a member of the Kruppel family of zinc finger proteins, and was originally cloned from a cDNA library from a blast crisis CML patient (Hromas et al., 1991, J Biol Chem 266:14183). MZF1 appears to play a critical role in hematopoetic stem cell differentiation, including modulation of CD34 and c-myb expression (Gaboli et al., 2001, Genes Dev 15:1625; Perrotti et al., 1995, Mol Cell Biol 15:6075). MZF1 −/− knock-out mice display an increase in hemapoetic progenitor proliferation which continues in long-term culture conditions (Gaboli et al., 2001, Genes Dev 15:1625). These data support the findings found in our human studies described about that MZF1 deregulation may disrupt normal differentiation, promoting the progression to advanced disease. Delta EF1 is related to the Smad zinc finger proteins that play an important role in TGFbeta gene regulation. Delta EF1 has been shown to compete with basic helix-loop-helix activators, and is implicated in modulation of MyoD regulated pathways (Funahashi et al., 1993, Development 119:433; Sekido et al., 1994, Mol Cell Biol 14:5692). It is not known if delta EF1 directly influences MDFI expression.

Of note is that both MZF1 and delta EF1 have been shown to influence cadherin expression (Guaita et al., 2002, J Biol Chem 277:39209; Le et al., 2005, Exp Cell Res 302:129; Miyoshi et al., 2004, Br J Cancer 90:1265). Thus, the further study of the control of MZF1 and delta EF1 may be particularly fruitful in understanding the molecular mechanisms of CML progression. Given that efficacy of treatment in CML (be it with interferon, imatinib, or transplantation) is so intimately associated with phase of disease, those patients who fail therapy in chronic phase may have genetic features of advanced phase invisible to routine pathological and cytogenetic exam. Imatinib failures are a reasonable setting to explore this possibility. While imatinib can cause cytogenetic remissions in the majority of chronic phase cases, treatment failure, especially secondary to point mutations, is an increasingly important problem. It has previously been demonstrated that the probability of developing a point mutation depends largely on the time from diagnosis to initiation of therapy (Branford et al., 2003, Blood 102:276). This finding implies that the genetic mechanisms that lead to point mutations are relentless, and therefore the treatment of "late" chronic phase patients (i.e., >1 year from diagnosis) may be undermined by genetic changes that have already occurred. Branford et al. demonstrated that patients who developed point mutations had a very poor outcome, with approximately half dying within a year of relapse (Branford et al., 2003, Blood 102: 276). These observations are in keeping with the demonstration in these examples that many imatinib failures have gene expression changes similar to advanced disease, despite their benign pathological appearance. Thus, resistance to imatinib may be ameliorated by either targeting pathways of progression (beta-catenin, JunB/Fos, etc.), or by targeting pathways specifically found activated in imatinib resistance cases (alternative kinases, protein transporters).

Several of the genes found in the progression set might serve as early markers of progression in diagnostic assays, and may serve as therapeutic targets, as well. For example, PRAME (Preferentially Expressed Antigen of Melanoma) was originally identified as a tumor antigen recognized by cytotoxic T-cells against a melanoma surface antigen (Matsushita et al., 2001, Br J Haematol 112:916, 2001; van Baren et al., 1998, Br J Haematol 102:1376). Like similar antigens MAGE, BAGE, and GAGE, which are expressed in some solid tumors; unlike these other antigens, however, PRAME has been found to be overexpressed in over 25% of leukemia, and has been found to be induced by Bcr-Abl in CML cell lines (Watari et al., 2000, FEBS Lett 466:367). Indeed, PRAME over-expression has been described as one of the few features that characterize the transient myeloproliferative syndrome of Down's syndrome from the progressive acute megakaryoblastic leukemia found in that disorder (McElwaine et al., 2004, Br J Haematol 125:729). While the function of PRAME is still unknown, its expression on the cell surface might be amenable to flow cytometry assays, as well as a target for immunologic (vaccine or cell-based) therapy. CD47, an integrin-like protein, is another potential diagnostic target discovered in our analysis of progression (Motegi et al., 2003, Embo J 22:2634; Okazawa et al., 2005, J Immunol 174:2004). In addition, the demonstration of aberrant regulation of alternative signaling pathways (FLT3; Rras2; beta-catenin. SOCS2), proteosomes, and chaperone proteins suggest that the targeting of several novel pathways may be needed in the treatment of advanced CML.

Compared to other types of leukemia, there have been few papers exploring the use of microarrays on the biology of CML. In sum, 23 patients of various stages have been studied, 10 on unsorted samples, 13 from AC133+ isolated cells. It is difficult to make a direct comparison of these studies and ours, given the different types of samples obtained, the difference in the array platforms (these studies used platforms examining 3,000-5,000 genes, compared to ~24,000 genes in this current study). In general, however, the functional changes of progression, e.g., changes in differentiation, apoptosis, and cell adhesion, remained as common themes across the study. In contrast to one study, no significant differences in signatures obtained from bone marrow and peripheral blood (FIG. 7) were found, which may be important in future prospective studies of this disease in patients.

These findings have the potential to influence therapy of CML. Patients who present with gene expression patterns suggestive of advanced phase disease might benefit to move straight to transplantation if a donor exists, or if not, other investigation therapies. Moreover, PCR assays of individual genes (or small sets of genes) may be used to monitor patients early in the course of imatinib therapy for signs of progression to advanced disease. Microarray studies of large cohorts of patients treated with imatinib will likely identify gene patterns indicative of response that can be used immediately at diagnosis to tailor therapy.

6.7. Materials and Methods

Patient samples. All samples were obtained under the auspices of institutional review board approve protocols. Samples came from the FHCRC, the Southwest Oncology Group (SWOG) Myeloid Repository, the University of Oregon Health Sciences Center, the University of California, Los Angeles, or the University of Chicago. RNA extraction was either performed immediately, or in the case of samples stored in a liquid nitrogen repository, after thawing. All RNA samples were quality tested by analysis of ribosomal RNA peaks using an ABI Bioalyzer. The definition of chronic, accelerated and blast crisis was based on the criteria of Sokal (Sokal et al., 1984, Blood 63:789).

Amplification, labeling, and hybridization. The procedures of RNA amplification, labeling, and the hybridization to arrays, as well as the specifics of the array platforms, has been previously published (Hughes et al., 2001, Nat Biotechnol 19:342).

Analytic Methods and Results. Each individual sample was hybridized to a pool of chronic phase samples. The log 10 (Ratio) of intensity of individual samples to the pool were used for the subsequent analysis. Before selecting features by ANOVA, 25,000 genes on the array were first screened for evidence of differential regulation by requiring P-value of regulation <1% in more than 3 experiments. Where P-value of regulation is based on the platform error model. Features differentiating progression stages were selected by ANOVA test.

Functional annotation of gene lists. Genes represented on the microarray were annotated by assignment to GO Biological Process or Molecular Function categories, or to KEGG pathways. Gene lists (input sets) were queried for enrichment of members of specific functional classes or pathways relative to the background frequency. The significance (P-value) of enrichment was computed using the hypergeometric probability distribution. Reported in each case are the numbers of genes in the input set (input gene count), number of genes in a particular category or pathway in the input set (overlap gene count), number of genes in a particular category among all genes present on the array (set gene count). The total number of unique genes on the array is 24132.

Methods to common promote site analysis. The common promoter sites were based on the predictions derived from the database (oPOSSUM) by Wasserman et al. (www.cisreg.ca). The hypergeometric P-value for enrichment of a particular binding site was computed by comparing the number of genes with the binding site from a signature gene set to that from a background set (i.e., all genes represented on the microarray).

Controls. We compared the genes found associated with progression to the genes found significantly over- and under-expressed with prolonged "transit time" from sample acquisition to RNA processing (Radich et al., 2004, Genomics 83:980). There gene signatures of the two data sets were different, excluding this artifact as contributing significantly to the progression gene set.

Lastly, we compared gene expression signatures from the sites contributing samples to confirm that there were no site-signatures confounding the analysis. We found no evidence of site-specific signatures.

As some samples of blast crisis came from peripheral blood rather than bone marrow, we compared three samples in which simultaneous samples were available from bone marrow and peripheral blood. Gene expression was extremely well correlated (r=0.97 to 0.99; FIG. 7).

TABLE 8

The phase reporter genes

| SUBS | GENE | DESCRIPTION | SP_XREF_KEYWORD_LIST | SEQ ID NO. | PROBE SEQ ID NO. |
|---|---|---|---|---|---|
| AB002301 | KIAA0303 | KIAA0303 protein | Hypothetical protein, ATP-binding, Kinase, Serine/threonine-protein kinase, Transferase | 1 | 3969 |
| AB002313 | PLXNB2 | plexin B2 | Hypothetical protein | 2 | 3970 |
| AB002314 | KIAA0316 | KIAA0316 gene product | Hypothetical protein | 3 | 3971 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AB002331 | DATF1 | death associated transcription factor 1 | Apoptosis, Nuclear protein, Zinc-finger, Alternative splicing | 4 | 3972 |
| AB002336 | EPB41L1 | erythrocyte membrane protein band 4.1-like 1 | Hypothetical protein, Structural protein, Cytoskeleton, Actin-binding | 5 | 3973 |
| AB002337 | KIAA0339 | KIAA0339 gene product | Hypothetical protein | 6 | 3974 |
| AB002354 | KIAA0356 | pleckstrin homology domain containing, family M (with RUN domain) member 1 | Hypothetical protein | 7 | 3975 |
| AB002359 | PFAS | phosphoribosylformylglycinamidine synthase (FGAR amidotransferase) | Purine biosynthesis, Ligase, ATP-binding, Glutamine amidotransferase, Hypothetical protein | 8 | 3976 |
| AB002360 | MCF2L | MCF.2 cell line derived transforming sequence-like | Hypothetical protein, Guanine-nucleotide releasing factor, Proto-oncogene | 9 | 3977 |
| AB002366 | KIAA0368 | KIAA0368 | Hypothetical protein | 10 | 3978 |
| AB002368 | XPO6 | exportin 6 | Hypothetical protein | 11 | 3979 |
| AB002369 | MTMR3 | myotubularin related protein 3 | Hydrolase, Zinc-finger, Alternative splicing, Hypothetical protein | 12 | 3980 |
| AB002373 | KIAA0375 | RUN and SH3 domain containing 2 | Hypothetical protein, SH3 domain | 13 | 3981 |
| AB002377 | KIAA0379 | ankyrin repeat domain 28 | Hypothetical protein, Repeat, ANK repeat | 14 | 3982 |
| AB002379 | DAAM2 | dishevelled associated activator of morphogenesis 2 | Coiled coil, Alternative splicing | 15 | 3983 |
| AB004857 | SLC11A2 | solute carrier family 11 (proton-coupled divalent metal ion transporters), member 2 | Transport, Iron transport, Transmembrane, Glycoprotein, Alternative splicing, Polymorphism | 16 | 3984 |
| AB006622 | KIAA0284 | KIAA0284 | Hypothetical protein | 17 | 3985 |
| AB007855 | TIX1 | zinc fingers and homeoboxes 3 | DNA-binding, Homeobox, Nuclear protein, Zinc-finger, Metal-binding, Repeat | 18 | 3986 |
| AB007863 | PIP3-E | phosphoinositide-binding protein PIP3-E | Hypothetical protein | 19 | 3987 |
| AB007864 | KIAA0404 | KIAA0404 protein | Hypothetical protein, Metal-binding, Oxidoreductase, Zinc | 20 | 3988 |
| AB007888 | MBNL1 | muscleblind-like (*Drosophila*) | Hypothetical protein, Zinc-finger, Repeat, Nuclear protein, RNA-binding, Alternative splicing | 21 | 3989 |
| AB007902 | AUTS2 | autism susceptibility candidate 2 | Chromosomal translocation, Polymorphism, Alternative splicing | 22 | 3990 |
| AB007915 | KIAA0446 | KIAA0446 gene product | Hypothetical protein | 23 | 3991 |
| AB007931 | RBAF600 | retinoblastoma-associated factor 600 | Hypothetical protein | 24 | 3992 |
| AB007941 | KIAA0472 | dusty protein kinase | ATP-binding, Transferase, Hypothetical protein, Kinase, Serine/threonine-protein kinase | 25 | 3993 |
| AB007958 | KIAA0489 | KIAA0792 gene product | Hypothetical protein | 26 | 3994 |
| AB007962 | KIAA0493 | KIAA0493 protein | | 27 | 3995 |
| AB007965 | CYHR1 | MRNA, chromosome 1 specific transcript KIAA0496. | | 28 | 3996 |
| AB007972 | PPP1R12B | protein phosphatase 1, regulatory (inhibitor) subunit 12B | ANK repeat, Myosin, Repeat | 29 | 3997 |
| AB011093 | P114-RHO-GEF | rho/rac guanine nucleotide exchange factor (GEF) 18 | Hypothetical protein | 30 | 3998 |
| AB011105 | LAMA5 | laminin, alpha 5 | Laminin EGF-like domain, Signal, Glycoprotein, Basement membrane, Extracellular matrix, Coiled coil, Cell adhesion, Repeat | 31 | 3999 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AB011112 | KIAA0540 | KIAA0540 protein | Hypothetical protein, Repeat, WD repeat | 32 | 4000 |
| AB011114 | KIAA0542 | KIAA0542 gene product | Hypothetical protein | 33 | 4001 |
| AB011133 | KIAA0561 | microtubule associated serine/threonine kinase 3 | Hypothetical protein, ATP-binding, Kinase, Serine/threonine-protein kinase, Transferase | 34 | 4002 |
| AB011136 | KIAA0564 | KIAA0564 protein | Hypothetical protein, ATP-binding | 35 | 4003 |
| AB011153 | PLCB1 | phospholipase C, beta 1 (phosphoinositide-specific) | Hydrolase, Lipid degradation, Transducer, Phosphorylation, Calcium, Alternative splicing | 36 | 4004 |
| AB011154 | RAB1A | KIAA0582 protein | Hypothetical protein | 37 | 4005 |
| AB011157 | PTDSR | phosphatidylserine receptor | Hypothetical protein, Receptor | 38 | 4006 |
| AB011167 | KIAA0595 | peroxisome proliferative activated receptor, gamma, coactivator-related 1 | Hypothetical protein | 39 | 4007 |
| AB011171 | KIAA0599 | KIAA0599 | Hypothetical protein, Plasmid | 40 | 4008 |
| AB011173 | KIAA0601 | amine oxidase (flavin containing) domain 2 | Hypothetical protein | 41 | 4009 |
| AB011542 | EGFL5 | EGF-like-domain, multiple 5 | Laminin EGF-like domain | 42 | 4010 |
| AB012692 | CAC-1 | beta-casein-like protein | Hypothetical protein | 43 | 4011 |
| AB014516 | MECT1 | Homo sapiens mRNA for KIAA0616 protein, partial cds. | Transcription regulation, DNA-binding, Activator, Nuclear protein, Phosphorylation, Cell cycle, Alternative splicing, 3D-structure, Polymorphism, Hypothetical protein | 44 | 4012 |
| AB014520 | PLXND1 | plexin D1 | Hypothetical protein | 45 | 4013 |
| AB014538 | KIAA0638 | pleckstrin homology-like domain, family B, member 1 | Hypothetical protein | 46 | 4014 |
| AB014543 | KIAA0643 | KIAA0643 protein | Hypothetical protein | 47 | 4015 |
| AB014548 | KIAA0648 | KIAA0648 protein | Hypothetical protein | 48 | 4016 |
| AB014557 | KIAA0657 | KIAA0657 protein | Hypothetical protein, Immunoglobulin domain | 49 | 4017 |
| AB014558 | CRY2 | cryptochrome 2 (photolyase-like) | Lyase, Hypothetical protein | 50 | 4018 |
| AB014564 | KIAA0664 | KIAA0664 protein | Hypothetical protein, Initiation factor, Protein biosynthesis | 51 | 4019 |
| AB014566 | DAAM1 | dishevelled associated activator of morphogenesis 1 | Coiled coil, Alternative splicing | 52 | 4020 |
| AB014567 | TIP120B | TBP-interacting protein | Hypothetical protein | 53 | 4021 |
| AB014568 | UNC84B | unc-84 homolog B (C. elegans) | Transmembrane, Nuclear protein, Coiled coil | 54 | 4022 |
| AB014574 | KIAA0674 | KIAA0674 protein | Hypothetical protein | 55 | 4023 |
| AB014578 | KIAA0678 | RME8 protein | Hypothetical protein | 56 | 4024 |
| AB014589 | CSTF2T | cleavage stimulation factor, 3' pre-RNA, subunit 2, 64 kDa, tau variant | Hypothetical protein | 57 | 4025 |
| AB014597 | GTAR | ankyrin repeat domain 17 | Hypothetical protein, ANK repeat, Repeat | 58 | 4026 |
| AB014600 | SIN3B | SIN3 homolog B, transcriptional regulator (yeast) | Transcription regulation, Repressor, Repeat, Nuclear protein | 59 | 4027 |
| AB014604 | OSBPL3 | oxysterol binding protein-like 3 | Lipid transport, Transport, Alternative splicing | 60 | 4028 |
| AB015330 | DKFZP761I2123 | hypothetical protein DKFZp761I2123 | Hypothetical protein | 61 | 4029 |
| AB015343 | HRIHFB2122 | Tara-like protein | Cytoskeleton, Actin-binding, Coiled coil, Nuclear protein | 62 | 4030 |
| AB018268 | KIAA0725 | SAM, WWE and DDHD domain containing 1 | Hypothetical protein | 63 | 4031 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AB018325 | CENTD2 | centaurin, delta 2 | GTPase activation, Repeat, Zinc-finger, Alternative splicing | 64 | 4032 |
| AB018339 | SYNE1 | spectrin repeat containing, nuclear envelope 1 | Structural protein, Cytoskeleton, Actin-binding, Coiled coil, Transmembrane, Repeat, Alternative splicing, Polymorphism | 65 | 4033 |
| AB018348 | PCNX | pecanex homolog (*Drosophila*) | Transmembrane, Glycoprotein, Alternative splicing | 66 | 4034 |
| AB018353 | UNC84A | unc-84 homolog A (*C. elegans*) | Transmembrane, Nuclear protein, Coiled coil, Alternative splicing | 67 | 4035 |
| AB020627 | KIAA0820 | dynamin family member | Hydrolase, Motor protein, GTP-binding, Microtubule, Multigene family, Endocytosis | 68 | 4036 |
| AB020636 | TIP120A | TBP-interacting protein | Hypothetical protein | 69 | 4037 |
| AB020637 | KIAA0830 | KIAA0830 protein | Hypothetical protein | 70 | 4038 |
| AB020644 | FACL6 | acyl-CoA synthetase long-chain family member 6 | Ligase, Fatty acid metabolism, Magnesium, Multigene family, Alternative splicing, Chromosomal translocation, Hypothetical protein | 71 | 4039 |
| AB020649 | KIAA0842 | pleckstrin homology domain containing, family M (with RUN domain) member 2 | Hypothetical protein | 72 | 4040 |
| AB020673 | MYH11 | myosin, heavy polypeptide 11, smooth muscle | Myosin, Muscle protein, Coiled coil, Thick filament, Actin-binding, Calmodulin-binding, ATP-binding, Methylation, Multigene family, Proto-oncogene, Chromosomal translocation | 73 | 4041 |
| AB020684 | KIAA0877 | KIAA0877 protein | Hypothetical protein | 74 | 4042 |
| AB020691 | KIAA0884 | GTPase activating RANGAP domain-like 1 | Hypothetical protein | 75 | 4043 |
| AB020695 | KIAA0888 | KIAA0888 protein | Hypothetical protein | 76 | 4044 |
| AB020698 | USP19 | ubiquitin specific protease 19 | Protease, Ubl conjugation pathway, Hydrolase, Thiol protease, Multigene family, Zinc-finger, Metal-binding | 77 | 4045 |
| AB020703 | DD5 | progestin induced protein | Ubl conjugation pathway, Ligase, Nuclear protein, 3D-structure | 78 | 4046 |
| AB020704 | PPFIA4 | protein tyrosine phosphatase, receptor type, f polypeptide (PTPRF), interacting protein (liprin), alpha 4 | Hypothetical protein | 79 | 4047 |
| AB023152 | KIAA0935 | mannosidase alpha class 2B member 2 | Hydrolase, Glycosidase, Signal, Glycoprotein, Hypothetical protein | 80 | 4048 |
| AB023154 | KIAA0937 | macrophage expressed gene 1 | Hypothetical protein, Metal-binding, Zinc, Zinc-finger | 81 | 4049 |
| AB023156 | SLC9A8 | solute carrier family 9 (sodium/hydrogen exchanger), isoform 8 | Hypothetical protein | 82 | 4050 |
| AB023164 | KIAA0947 | KIAA0947 protein | Hypothetical protein | 83 | 4051 |
| AB023210 | WDFY3 | WD repeat and FYVE domain containing 3 | Hypothetical protein, Repeat, WD repeat | 84 | 4052 |
| AB023211 | PADI2 | peptidyl arginine deiminase, type II | Hydrolase, Calcium-binding, Multigene family | 85 | 4053 |
| AB023212 | PCNX | pecanex homolog (*Drosophila*) | Transmembrane, Glycoprotein, Alternative splicing | 86 | 4054 |
| AB023216 | KIAA0999 | KIAA0999 protein | Hypothetical protein, ATP-binding, Kinase, Serine/threonine-protein kinase, Transferase | 87 | 4055 |
| AB023230 | KIAA1013 | GRP1-binding protein GRSP1 | Hypothetical protein, Cytoskeleton | 88 | 4056 |
| AB023233 | CHDC1 | calponin homology (CH) domain containing 1 | Hypothetical protein, Leucine-rich repeat, Repeat | 89 | 4057 |
| AB025254 | PCTAIRE2BP | tudor repeat associator with PCTAIRE 2 | Hypothetical protein | 90 | 4058 |
| AB026054 | ZNF179 | zinc finger protein 179 | Zinc-finger | 91 | 4059 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AB026436 | DUSP10 | dual specificity phosphatase 10 | Hydrolase, Nuclear protein, Hypothetical protein | 92 | 4060 |
| AB028972 | KIAA1049 | KIAA1049 protein | Hypothetical protein | 93 | 4061 |
| AB028978 | KIAA1055 | KIAA1055 protein | Hypothetical protein | 94 | 4062 |
| AB028980 | USP24 | ubiquitin specific protease 24 | Hypothetical protein, Ubl conjugation pathway, Hydrolase, Thiol protease, Multigene family | 95 | 4063 |
| AB028986 | USP22 | ubiquitin specific protease 22 | Hypothetical protein, Protease, Ubl conjugation pathway, Hydrolase, Thiol protease, Multigene family | 96 | 4064 |
| AB028989 | MAPK8IP3 | mitogen-activated protein kinase 8 interacting protein 3 | Phosphorylation, Coiled coil | 97 | 4065 |
| AB028994 | AMOT | angiomotin | Hypothetical protein | 98 | 4066 |
| AB029030 | KIAA1107 | KIAA1107 protein | Hypothetical protein | 99 | 4067 |
| AB029032 | FLJ21404 | hypothetical protein KIAA1109 | Hypothetical protein | 100 | 4068 |
| AB029041 | KIAA1118 | likely ortholog of mouse 5-azacytidine induced gene 1 | Hypothetical protein | 101 | 4069 |
| AB032952 | KIAA1126 | KIAA1126 protein | Hypothetical protein | 102 | 4070 |
| AB032965 | CASKIN2 | CASK interacting protein 2 | Hypothetical protein, ANK repeat, Repeat | 103 | 4071 |
| AB032973 | LCHN | LCHN protein | Hypothetical protein | 104 | 4072 |
| AB032976 | P66 | transcription repressor p66 beta component of the MeCP1 complex | Hypothetical protein | 105 | 4073 |
| AB032993 | GRIPAP1 | GRIP1 associated protein 1 | Hypothetical protein | 106 | 4074 |
| AB033009 | KIAA1183 | KIAA1183 protein | Hypothetical protein | 107 | 4075 |
| AB033037 | KIAA1211 | KIAA1211 protein | Hypothetical protein | 108 | 4076 |
| AB033050 | RAI17 | retinoic acid induced 17 | Hypothetical protein | 109 | 4077 |
| AB033053 | ZNF295 | zinc finger protein 295 | Transcription regulation, DNA-binding, Zinc-finger, Metal-binding, Nuclear protein, Repeat | 110 | 4078 |
| AB033055 | KIAA1229 | KIAA1229 protein | Hypothetical protein | 111 | 4079 |
| AB033068 | FZR1 | Fzr1 protein | Hypothetical protein, Ubl conjugation pathway, Cell cycle, Cell division, Mitosis, Repeat, WD repeat, Phosphorylation, Alternative splicing | 112 | 4080 |
| AB033070 | KIAA1244 | KIAA1244 | Hypothetical protein | 113 | 4081 |
| AB033073 | KIAA1247 | sulfatase 2 | Hydrolase, Signal, Glycoprotein, Endoplasmic reticulum, Golgi stack | 114 | 4082 |
| AB033085 | KIAA1259 | hypothetical protein KIAA1259 | Hypothetical protein, ATP-binding, Helicase, Hydrolase | 115 | 4083 |
| AB033087 | TLE4 | transducin-like enhancer of split 4 (E(sp1) homolog, *Drosophila*) | Transcription regulation, Repressor, Nuclear protein, Repeat, WD repeat, Phosphorylation, Wnt signaling pathway | 116 | 4084 |
| AB033091 | KIAA1265 | solute carrier family 39 (zinc transporter), member 10 | Hypothetical protein | 117 | 4085 |
| AB033092 | MTA3 | metastasis associated family, member 3 | Hypothetical protein, Zinc-finger, Nuclear protein, Alternative splicing | 118 | 4086 |
| AB033100 | KIAA1274 | KIAA protein (similar to mouse paladin) | Hypothetical protein | 119 | 4087 |
| AB033108 | KCNH3 | potassium voltage-gated channel, subfamily H (eag-related), member 3 | Hypothetical protein, Transport, Ion transport, Ionic channel, Voltage-gated channel, Potassium channel, Potassium transport, Transmembrane, Glycoprotein, Multigene family | 120 | 4088 |
| AB033112 | BRPF3 | bromodomain and PHD finger containing, 3 | Hypothetical protein, Zinc-finger, Bromodomain | 121 | 4089 |
| AB033118 | ZDHHC8 | zinc finger, DHHC domain containing 8 | Transmembrane, Zinc-finger, Hypothetical protein | 122 | 4090 |
| AB037716 | KIAA1295 | KIAA1295 protein | Hypothetical protein, SH3 domain | 123 | 4091 |
| AB037720 | SH2B | SH2-B homolog | Hypothetical protein | 124 | 4092 |
| AB037721 | STARD9 | START domain containing 9 | Hypothetical protein | 125 | 4093 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AB037722 | KIAA1301 | NEDD4-related E3 ubiquitin ligase NEDL2 | Hypothetical protein | 126 | 4094 |
| AB037729 | RALGDS | ral guanine nucleotide dissociation stimulator | Guanine-nucleotide releasing factor, 3D-structure, Hypothetical protein | 127 | 4095 |
| AB037749 | KIAA1328 | KIAA1328 protein | Hypothetical protein | 128 | 4096 |
| AB037757 | KIAA1336 | WD repeat domain 35 | Hypothetical protein, Repeat, WD repeat | 129 | 4097 |
| AB037760 | ZNF398 | zinc finger protein 398 | Transcription regulation, Activator, DNA-binding, Zinc-finger, Metal-binding, Nuclear protein, Repeat, Alternative splicing | 130 | 4098 |
| AB037771 | KIAA1350 | ubiquitin specific protease 53 | Hypothetical protein | 131 | 4099 |
| AB037787 | NLGN2 | neuroligin 2 | Cell adhesion, Glycoprotein, Signal, Transmembrane | 132 | 4100 |
| AB037795 | KIAA1374 | KIAA1374 protein | Hypothetical protein, Repeat, WD repeat | 133 | 4101 |
| AB037802 | COG1 | component of oligomeric golgi complex 1 | Transport, Protein transport, Golgi stack, Membrane | 134 | 4102 |
| AB037813 | DKFZp762K222 | hypothetical protein DKFZp762K222 | Hypothetical protein | 135 | 4103 |
| AB037814 | KIAA1393 | KIAA1393 | Hypothetical protein | 136 | 4104 |
| AB037836 | PRex1 | phosphatidylinositol 3,4,5-trisphosphate-dependent RAC exchanger 1 | Guanine-nucleotide releasing factor, Repeat, Alternative splicing | 137 | 4105 |
| AB037845 | ARHGAP10 | Rho GTPase activating protein 21 | Hypothetical protein | 138 | 4106 |
| AB037851 | KIAA1430 | KIAA1430 protein | Hypothetical protein | 139 | 4107 |
| AB037855 | KIAA1434 | hypothetical protein KIAA1434 | Hypothetical protein | 140 | 4108 |
| AB037859 | MKL1 | megakaryoblastic leukemia (translocation) 1 | Transcription regulation, Nuclear protein, Coiled coil, Repeat, Chromosomal translocation, Protooncogene | 141 | 4109 |
| AB037860 | NFIA | nuclear factor I/A | Activator, DNA replication, DNA-binding, Nuclear protein, Transcription, Transcription regulation, Multigene family | 142 | 4110 |
| AB037861 | DKFZP586J0619 | DKFZP586J0619 Protein | Hypothetical protein | 143 | 4111 |
| AB040881 | KIF1B | kinesin family member 1B | Hypothetical protein, Motor protein, Microtubule, ATP-binding, Coiled coil, Mitochondrion, Alternative splicing, Disease mutation, Charcot-Marie-Tooth disease | 144 | 4112 |
| AB040900 | KIAA1467 | KIAA1467 protein | Hypothetical protein | 145 | 4113 |
| AB040907 | KIAA1474 | zinc finger protein 537 | Hypothetical protein, Metal-binding, Zinc, Zinc-finger | 146 | 4114 |
| AB040908 | VPS18 | vacuolar protein sorting protein 18 | Transport, Protein transport, Membrane, Zinc-finger, Coiled coil, Alternative splicing | 147 | 4115 |
| AB040917 | KIAA1484 | leucine rich repeat and fibronectin type III domain containing 1 | Hypothetical protein, Immunoglobulin domain | 148 | 4116 |
| AB040930 | LRRN1 | leucine rich repeat neuronal 1 | Hypothetical protein, Immunoglobulin domain | 149 | 4117 |
| AB040942 | KIAA1509 | KIAA1509 | Hypothetical protein, Plasmid | 150 | 4118 |
| AB040955 | KIAA1522 | KIAA1522 protein | Hypothetical protein | 151 | 4119 |
| AB040960 | FLJ22670 | lymphocyte alpha-kinase | Hypothetical protein, Kinase | 152 | 4120 |
| AB040961 | DTX2 | deltex homolog 2 (*Drosophila*) | Nuclear protein, Repeat, Metal-binding, Zinc, Zinc-finger, Alternative splicing, Polymorphism | 153 | 4121 |
| AB040968 | HCN3 | hyperpolarization activated cyclic nucleotide-gated potassium channel 3 | Transport, Ion transport, Ionic channel, Voltage-gated channel, Potassium channel, Potassium, Potassium transport, Sodium transport, cAMP, cAMP-binding, Transmembrane, Glycoprotein, Sodium channel | 154 | 4122 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AB040969 | KIAA1536 | KIAA1536 protein | Hypothetical protein | 155 | 4123 |
| AB040972 | FLJ11560 | Homo sapiens mRNA for KIAA1539 protein, partial cds. | Hypothetical protein | 156 | 4124 |
| AF000560 | | hypothetical protein LOC126208 | Metal-binding, Zinc, Zinc-finger | 157 | 4125 |
| AF007217 | TRIP11 | thyroid hormone receptor interactor 11 | Antigen, Golgi stack, Coiled coil, Chromosomal translocation, Hypothetical protein | 158 | 4126 |
| AF011757 | S100A12 | S100 calcium binding protein A12 (calgranulin C) | Calcium-binding, Zinc, Metal-binding | 159 | 4127 |
| AF016267 | TNFRSF10C | tumor necrosis factor receptor superfamily, member 10c, decoy without an intracellular domain | Receptor, Apoptosis, Glycoprotein, Repeat, GPI-anchor, Signal, Lipoprotein | 160 | 4128 |
| AF016495 | AQP9 | aquaporin 9 | Transport, Repeat, Transmembrane | 161 | 4129 |
| AF017433 | ZNF213 | zinc finger protein 213 | Transcription regulation, DNA-binding, Zinc-finger, Metal-binding, Nuclear protein, Repeat | 162 | 4130 |
| AF026816 | ITPA | inosine triphosphatase (nucleoside triphosphate pyrophosphatase) | Hydrolase, Nucleotide metabolism, Disease mutation | 163 | 4131 |
| AF031166 | SRP46 | Splicing factor, arginine/serine-rich, 46 kD | | 164 | 4132 |
| AF034803 | PPFIBP2 | PTPRF interacting protein, binding protein 2 (liprin beta 2) | Receptor, Hypothetical protein | 165 | 4133 |
| AF035307 | | plexin C1 | | 166 | 4134 |
| AF038193 | | ADP-ribosylation factor-like 3 | GTP-binding, Multigene family, Polymorphism | 167 | 4135 |
| AF038535 | SYT7 | synaptotagmin VII | Transmembrane, Repeat, Synapse | 168 | 4136 |
| AF038554 | DENR | density-regulated protein | Hypothetical protein | 169 | 4137 |
| AF043469 | NXPH4 | serine hydroxymethyltransferase 2 (mitochondrial) | Transferase, Methyltransferase, Pyridoxal phosphate, One-carbon metabolism, Mitochondrion, Transit peptide, Glycoprotein, Repeat, Signal, Hypothetical protein | 170 | 4138 |
| AF045229 | RGS10 | regulator of G-protein signalling 10 | Signal transduction inhibitor, Lipoprotein, Palmitate, Alternative splicing, Polymorphism | 171 | 4139 |
| AF049140 | UBE2V2 | ubiquitin-conjugating enzyme E2 variant 2 | Ligase, Ubl conjugation pathway, Vitamin D | 172 | 4140 |
| AF052093 | NJMU-R1 | protein kinase Njmu-R1 | | 173 | 4141 |
| AF052117 | | chloride channel 4 | Ionic channel, Ion transport, Chloride channel, Chloride, Voltage-gated channel, Transmembrane, CBS domain, Repeat | 174 | 4142 |
| AF052159 | | protein tyrosine phosphatase-like (proline instead of catalytic arginine), member b | | 175 | 4143 |
| AF052167 | MRS2L | MRS2-like, magnesium homeostasis factor (S. cerevisiae) | Signal, Hypothetical protein | 176 | 4144 |
| AF052169 | LOC115207 | potassium channel tetramerisation domain containing 12 | Hypothetical protein | 177 | 4145 |
| AF052181 | | epimorphin | | 178 | 4146 |
| AF055006 | SEC6 | SEC6-like 1 (S. cerevisiae) | Hypothetical protein, Exocytosis, Transport, Protein transport, Coiled coil, Alternative splicing | 179 | 4147 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AF055012 | TGIF2 | TGFB-induced factor 2 (TALE family homeobox) | DNA-binding, Homeobox, Transcription regulation, Nuclear protein, Phosphorylation | 180 | 4148 |
| AF055016 | C13orf1 | chromosome 13 open reading frame 1 | Hypothetical protein | 181 | 4149 |
| AF055019 | | homeodomain interacting protein kinase 2 | Transferase, Serine/threonine-protein kinase, ATP-binding, Nuclear protein, Alternative splicing | 182 | 4150 |
| AF055029 | | hypothetical protein LOC151162 | | 183 | 4151 |
| AF055270 | SFRS7 | *Homo sapiens* heat-shock suppressed protein 1 (HSSG1) mRNA, complete cds. | Nuclear protein, RNA-binding, mRNA splicing, Alternative splicing, Phosphorylation, Repeat, Zinc-finger, Hypothetical protein | 184 | 4152 |
| AF059531 | PRMT3 | protein arginine N-methyltransferase 3 | Hypothetical protein, Transferase, Methyltransferase, Zinc-finger | 185 | 4153 |
| AF062341 | CTNND1 | catenin (cadherin-associated protein), delta 1 | Cytoskeleton, Structural protein, Phosphorylation, Repeat, Cell adhesion, Coiled coil, Nuclear protein, Alternative splicing | 186 | 4154 |
| AF063020 | PSIP2 | PC4 and SFRS1 interacting protein 1 | Receptor | 187 | 4155 |
| AF067972 | DNMT3A | DNA (cytosine-5-)-methyltransferase 3 alpha | Methyltransferase, Transferase, Zinc-finger, Metal-binding, Nuclear protein, Hypothetical protein | 188 | 4156 |
| AF068296 | MRPS35 | mitochondrial ribosomal protein S35 | Hypothetical protein, Ribosomal protein, Mitochondrion | 189 | 4157 |
| AF070587 | | Clone 24741 mRNA sequence | | 190 | 4158 |
| AF070643 | LOC55977 | intraflagellar transport protein IFT20 | | 191 | 4159 |
| AF072810 | BAZ1B | bromodomain adjacent to zinc finger domain, 1B | Transcription regulation, Bromodomain, Zinc-finger, Coiled coil, Nuclear protein, Alternative splicing, Williams-Beuren syndrome | 192 | 4160 |
| AF073519 | SERF1A | small EDRK-rich factor 1A (telomeric) | Alternative splicing | 193 | 4161 |
| AF073931 | CACNA1H | calcium channel, voltage-dependent, alpha 1H subunit | Ionic channel, Transmembrane, Ion transport, Voltage-gated channel, Calcium channel, Glycoprotein, Repeat, Multigene family, Calcium-binding, Phosphorylation, Alternative splicing | 194 | 4162 |
| AF077965 | CLN3 | ceroid-lipofuscinosis, neuronal 3, juvenile (Batten, Spielmeyer-Vogt disease) | Transmembrane, Lysosome, Glycoprotein, Alternative splicing, Neuronal ceroid lipofuscinosis, Disease mutation | 195 | 4163 |
| AF078843 | LOC51202 | DEAD (Asp-Glu-Ala-Asp) box polypeptide 47 | ATP-binding, Helicase, Hydrolase, Hypothetical protein | 196 | 4164 |
| AF085243 | ZNF236 | zinc finger protein 236 | Metal-binding, Nuclear protein, Zinc, Zinc-finger, Hypothetical protein, Transcription regulation, DNA-binding, Repeat, Alternative splicing | 197 | 4165 |
| AF090935 | C20orf3 | *Homo sapiens* clone HQ0569. | Transmembrane, Signal-anchor, Glycoprotein, Polymorphism | 198 | 4166 |
| AF097021 | GW112 | differentially expressed in hematopoietic lineages | | 199 | 4167 |
| AF112213 | C20orf24 | chromosome 20 open reading frame 24 | Alternative splicing | 200 | 4168 |
| AF112219 | ESD | esterase D/formylglutathione hydrolase | Hydrolase, Serine esterase, Polymorphism | 201 | 4169 |
| AF113694 | NF2 | neurofibromin 2 (bilateral acoustic neuroma) | Structural protein, Cytoskeleton, Anti-oncogene, Disease mutation, Alternative splicing, Deafness, 3D-structure | 202 | 4170 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AF114264 | nexilin | nexilin (F actin binding protein) | Hypothetical protein | 203 | 4171 |
| AF116238 | PUS1 | pseudoundylate synthase 1 | Lyase, tRNA processing, Nuclear protein | 204 | 4172 |
| AF117236 | MATR3 | matrin 3 | Nuclear protein, RNA-binding, Repeat, Zinc-finger | 205 | 4173 |
| AF119665 | PP | pyrophosphatase (inorganic) | Hydrolase, Metal-binding, Magnesium | 206 | 4174 |
| AF119856 | PRO1851 | Homo sapiens mRNA for PK-120, complete cds. | Acute phase, Serine protease inhibitor, Repeat, Signal, Multigene family, Glycoprotein, Alternative splicing, Polymorphism | 207 | 4175 |
| AF121856 | SNX6 | sorting nexin 6 | Hypothetical protein, Transport, Protein transport | 208 | 4176 |
| AF126749 | SCA8 | SCA8 mRNA, repeat region | | 209 | 4177 |
| AF127765 | CAPN3 | calpain 3, (p94) | Hydrolase, Thiol protease, Calcium-binding, Multigene family, Repeat, Disease mutation, Polymorphism, Alternative splicing | 210 | 4178 |
| AF131760 | LRP10 | low density lipoprotein receptor-related protein 10 | Hypothetical protein, Plasmid | 211 | 4179 |
| AF131764 | MPP5 | membrane protein, palmitoylated 5 (MAGUK p55 subfamily member 5) | Hypothetical protein, SH3 domain, Membrane | 212 | 4180 |
| AF131768 | FLJ13657 | chromosome 9 open reading frame 82 | Hypothetical protein | 213 | 4181 |
| AF131774 | FLJ14800 | hypothetical protein FLJ14800 | Hypothetical protein | 214 | 4182 |
| AF131775 | MGC5560 | hypothetical protein MGC5560 | Hypothetical protein | 215 | 4183 |
| AF131784 | | RAB27B, member RAS oncogene family | GTP-binding, Lipoprotein, Prenylation | 216 | 4184 |
| AF131803 | MGC5508 | hypothetical protein MGC5508 | Hypothetical protein | 217 | 4185 |
| AF131812 | | likely ortholog of mouse monocyte macrophage 19 | Hypothetical protein | 218 | 4186 |
| AF131838 | FLJ12806 | hypothetical protein FLJ12806 | Hypothetical protein | 219 | 4187 |
| AF131842 | KIAA1857 | netrin G2 | Hypothetical protein, EGF-like domain, Laminin EGF-like domain, Neurogenesis, Glycoprotein, GPI-anchor, Membrane, Signal, Repeat, Lipoprotein | 220 | 4188 |
| AF131859 | PA | sulfide quinone reductase-like (yeast) | Oxidoreductase, Flavoprotein, FAD, NADP, Mitochondrion, Transit peptide, Polymorphism | 221 | 4189 |
| AF134404 | FADS3 | fatty acid desaturase 3 | Heme | 222 | 4190 |
| AF146277 | CD2AP | CD2-associated protein | SH3 domain, SH3-binding, Phosphorylation, Coiled coil, Repeat | 223 | 4191 |
| AF152338 | PCDHGC4 | protocadherin gamma subfamily C, 3 | Calcium, Calcium-binding, Cell adhesion, Glycoprotein, Transmembrane, Alternative splicing, Repeat, Signal, Multigene family | 224 | 4192 |
| AF152339 | PCDHGC5 | protocadherin gamma subfamily C, 3 | Calcium, Calcium-binding, Cell adhesion, Glycoprotein, Transmembrane, Alternative splicing, Repeat, Signal, Multigene family | 225 | 4193 |
| AF155107 | FLJ11806 | nuclear protein UKp68 | Plasmid, Hypothetical protein | 226 | 4194 |
| AF156603 | WBSCR14 | Williams Beuren syndrome chromosome region 14 | Transcription regulation, Repressor, Nuclear protein, DNA-binding, Williams-Beuren syndrome, Alternative splicing | 227 | 4195 |
| AF161339 | ARHGAP9 | Rho GTPase activating protein 9 | Hypothetical protein, SH3 domain | 228 | 4196 |
| AF161417 | DKFZp564D177 | nipsnap homolog 3A (C. elegans) | Hypothetical protein | 229 | 4197 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AF161442 | HSPC324 | Similar to HSPC324 (LOC389811), mRNA | | 230 | 4198 |
| AF167706 | CRIM1 | cysteine-rich motor neuron 1 | Signal | 231 | 4199 |
| AF187859 | HSPBP1 | hsp70-interacting protein | Hypothetical protein | 232 | 4200 |
| AF202063 | FGFR4 | fibroblast growth factor receptor 4 | ATP-binding, Immunoglobulin domain, Kinase, Receptor, Transferase, Tyrosine-protein kinase, Glycoprotein, Phosphorylation, Transmembrane, Repeat, Signal, Polymorphism, 3D-structure | 233 | 4201 |
| AF209931 | 7h3 | hypothetical protein FLJ13511 | Hypothetical protein | 234 | 4202 |
| AF212842 | LILRA3 | leukocyte Ig-like receptor 9 | Receptor, Repeat, Signal, Immune response, Immunoglobulin domain, Glycoprotein, Antigen, Multigene family, Polymorphism | 235 | 4203 |
| AF217798 | NDEL1 | nudE nuclear distribution gene E homolog like 1 (*A. nidulans*) | Hypothetical protein | 236 | 4204 |
| AF220417 | LGTN | ligatin | Membrane, Alternative splicing | 237 | 4205 |
| AF222694 | LGALS12 | lectin, galactoside-binding, soluble, 12 (galectin 12) | Galectin, Lectin, Repeat, Nuclear protein, Alternative splicing | 238 | 4206 |
| AF227924 | SIGLEC9 | sialic acid binding Ig-like lectin 9 | Cell adhesion, Lectin, Antigen, Transmembrane, Signal, Glycoprotein, Immunoglobulin domain, Repeat, Polymorphism | 239 | 4207 |
| AF228704 | GSR | glutathione reductase | FAD, Flavoprotein, Oxidoreductase, Redox-active center, NADP, Acetylation, Alternative initiation, Mitochondrion, Transit peptide, 3D-structure, Polymorphism | 240 | 4208 |
| AF232216 | PIH1 | *Homo sapiens* pregnancy-induced hypertension syndrome-related protein (PIH1) mRNA, partial cds. | | 241 | 4209 |
| AF237413 | RAP1GDS1 | RAP1, GTP-GDP dissociation stimulator 1 | GTPase activation, Repeat, Alternative splicing | 242 | 4210 |
| AF241831 | HABP4 | hyaluronan binding protein 4 | Hypothetical protein | 243 | 4211 |
| AF242771 | | Mesenchymal stem cell protein DSC96 mRNA, partial cds | | 244 | 4212 |
| AF244088 | ZNF16 | zinc finger protein 16 (KOX 9) | Hypothetical protein, Metal-binding, Nuclear protein, Zinc, Zinc-finger, Transcription regulation, DNA-binding, Repeat | 245 | 4213 |
| AF246221 | ITM2B | integral membrane protein 2B | Hypothetical protein, Transmembrane, Signal-anchor, Disease mutation, Amyloid, Deafness | 246 | 4214 |
| AF257175 | PECI | peroxisomal D3,D2-enoyl-CoA isomerase | Isomerase, Peroxisome, Hypothetical protein | 247 | 4215 |
| AF260261 | ABI-2 | abl interactor 2 | Kinase, SH3 domain | 248 | 4216 |
| AF272357 | NPDC1 | neural proliferation, differentiation and control, 1 | Signal, Transmembrane, Hypothetical protein | 249 | 4217 |
| AI076473_RC | | rap2 interacting protein x | Hypothetical protein | 250 | 4218 |
| AI282511_RC | PTRF | hypothetical protein FLJ10534 | Hypothetical protein | 251 | 4219 |
| AI286310_RC | HSPA5 | qu91g07.x1 NCI_CGAP_Gas4 *Homo sapiens* cDNA clone IMAGE: 1979484 3' | ATP-binding, Endoplasmic reticulum, Signal | 252 | 4220 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| | | similar to gb: M19645_cds1 78 KD GLUCOSE REGULATED PROTEIN PRECURSOR (HUMAN); mRNA sequence. | | | |
| AI339981_RC | | hypothetical protein LOC153346 | | 253 | 4221 |
| AI347139_RC | | hypothetical protein MGC39372 | | 254 | 4222 |
| AI355990_RC | | qy51g12.x1 NCI_CGAP_Brn23 *Homo sapiens* cDNA clone IMAGE: 2015590 3', mRNA sequence. | | 255 | 4223 |
| AI434777_RC | | CDNA FLJ44280 fis, clone TRACH2001684 | | 256 | 4224 |
| AI493593_RC | | th39c02.x1 NCI_CGAP_Pan1 *Homo sapiens* cDNA clone IMAGE: 2120642 3', mRNA sequence. | | 257 | 4225 |
| AI668686_RC | FLJ38281 | hypothetical protein FLJ38281 | Hypothetical protein, Metal-binding, Zinc, Zinc-finger | 258 | 4226 |
| AI677876_RC | | CDNA clone IMAGE: 4648334, partial cds | | 259 | 4227 |
| AI695056_RC | | Sarcoma antigen NY-SAR-79 mRNA, partial cds | | 260 | 4228 |
| AI928427_RC | | Transcribed sequences | | 261 | 4229 |
| AJ000480 | C8FW | phosphoprotein regulated by mitogenic pathways | ATP-binding, Receptor, Transferase | 262 | 4230 |
| AJ010228 | RFPL1 | ret finger protein-like 1 | Zinc-finger, Metal-binding | 263 | 4231 |
| AJ010842 | NTPBP | XPA binding protein 1 | GTP-binding | 264 | 4232 |
| AJ011414 | plexin-B1/SEP | plexin B1 | Hypothetical protein, Receptor, Signal | 265 | 4233 |
| AJ133115 | THG-1 | TSC-22-like | Hypothetical protein, Transcription regulation, Repressor, Nuclear protein | 266 | 4234 |
| AJ225028 | GABBR1 | gamma-aminobutyric acid (GABA) B receptor, 1 | Hypothetical protein, G-protein coupled receptor, Postsynaptic membrane, Repeat, Signal, Transmembrane, Coiled coil, Sushi, Glycoprotein, Alternative splicing, Polymorphism, Receptor | 267 | 4235 |
| AJ243107 | APAF1 | *Homo sapiens* mRNA for apoptotic protease activating factor-1 (Apaf-1 gene) (short form). | Apoptosis, ATP-binding, Repeat, WD repeat, Alternative splicing, 3D-structure | 268 | 4236 |
| AJ249377 | IGHM | immunoglobulin lambda joining 3 | Immunoglobulin domain, Immunoglobulin C region, Glycoprotein, Repeat, Pyrrolidone carboxylic acid, Polymorphism, Membrane, Hypothetical protein, Receptor, T-cell, Signal | 269 | 4237 |
| AJ270996 | TRPM5 | transient receptor potential cation channel, subfamily M, member 5 | Ionic channel, Transmembrane | 270 | 4238 |
| AJ271684 | CLECSF5 | C-type (calcium dependent, carbohydrate-recognition domain) lectin, superfamily member 5 | Transmembrane, Lectin | 271 | 4239 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AJ272057 | STRAIT11499 | MID1 interacting G12-like protein | Hypothetical protein | 272 | 4240 |
| AK000001 | FLJ00001 | chromosome 9 open reading frame 28 | Hypothetical protein | 273 | 4241 |
| AK000004 | FGD3 | FGD1 family, member 3 | | 274 | 4242 |
| AK000007 | FLJ00007 | hypothetical protein FLJ00007 | SH3 domain | 275 | 4243 |
| AK000014 | HYPE | Huntingtin interacting protein E | Hypothetical protein | 276 | 4244 |
| AK000035 | FLJ22390 | hypothetical protein FLJ22390 | Hypothetical protein | 277 | 4245 |
| AK000168 | KIAA1919 | Homo sapiens cDNA FLJ20161 fis, clone COL09252, highly similar to L33930 Homo sapiens CD24 signal transducer mRNA. | Hypothetical protein | 278 | 4246 |
| AK000175 | | hypothetical protein LOC93444 | | 279 | 4247 |
| AK000212 | FLJ10140 | tRNA (5-methylaminomethyl-2-thiouridylate)-methyltransferase 1 | Hypothetical protein, Transferase, Methyltransferase, tRNA processing | 280 | 4248 |
| AK000216 | FLJ20209 | hypothetical protein FLJ20209 | | 281 | 4249 |
| AK000242 | RALGDS | ral guanine nucleotide dissociation stimulator | Guanine-nucleotide releasing factor, 3D-structure, Hypothetical protein | 282 | 4250 |
| AK000260 | CDK5RAP3 | Homo sapiens cDNA FLJ20253 fis, clone COLF6895. | | 283 | 4251 |
| AK000354 | KIAA1892 | KIAA1892 | Hypothetical protein, Repeat, WD repeat | 284 | 4252 |
| AK000425 | FLJ25555 | hypothetical protein FLJ25555 | Hypothetical protein | 285 | 4253 |
| AK000435 | LOC90987 | zinc finger protein 251 | Hypothetical protein, Metal-binding, Nuclear protein, Zinc, Zinc-finger | 286 | 4254 |
| AK000539 | DKFZP564K0822 | hypothetical protein DKFZp564K0822 | Hypothetical protein | 287 | 4255 |
| AK000552 | WDR5 | WD repeat domain 5 | Hypothetical protein, WD repeat, Repeat | 288 | 4256 |
| AK000617 | NFRKB | hypothetical protein LOC92912 | Hypothetical protein, Ligase, Ubl conjugation pathway | 289 | 4257 |
| AK000660 | | cyclin-dependent kinase 6 | | 290 | 4258 |
| AK000684 | FLJ22104 | hypothetical protein FLJ22104 | Hypothetical protein | 291 | 4259 |
| AK000689 | CLONE24945 | arrestin domain containing 2 | Hypothetical protein | 292 | 4260 |
| AK000703 | FLJ20696 | hypothetical protein FLJ20696 | Hypothetical protein | 293 | 4261 |
| AK000729 | | solute carrier family 36 (proton/amino acid symporter), member 1 | Hypothetical protein | 294 | 4262 |
| AK000757 | BCL2L1 | sortilin 1 | Apoptosis, Mitochondrion, Alternative splicing, Transmembrane, 3D-structure | 295 | 4263 |
| AK000787 | | CDNA FLJ20780 fis, clone COL04256 | | 296 | 4264 |
| AK000803 | | hypothetical protein LOC90624 | | 297 | 4265 |
| AK000808 | MGC4796 | Ser/Thr-like kinase | Hypothetical protein, ATP-binding, Kinase, Serine/threonine-protein kinase, Transferase | 298 | 4266 |
| AK000822 | DKFZP564M182 | DKFZP564M182 protein | Hypothetical protein | 299 | 4267 |
| AK000824 | TCTA | T-cell leukemia translocation altered gene | | 300 | 4268 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AK000838 | KIAA1295 | KIAA1295 protein | Hypothetical protein | 301 | 4269 |
| AK000933 | | opsin 3 (encephalopsin, panopsin) | Photoreceptor, Retinal protein, Transmembrane, Lipoprotein, Palmitate, G-protein coupled receptor, GTPase activation | 302 | 4270 |
| AK000939 | | hypothetical protein LOC286272 | | 303 | 4271 |
| AK000967 | 3PAP | phosphatidylinositol-3-phosphate associated protein | Hypothetical protein | 304 | 4272 |
| AK001022 | ISL2 | ISL2 transcription factor, LIM/homeodomain, (islet-2) | Homeobox, DNA-binding, Developmental protein, Nuclear protein, Repeat, LIM domain, Metal-binding, Zinc, Multigene family | 305 | 4273 |
| AK001036 | | MAD, mothers against decapentaplegic homolog 5 (*Drosophila*) | Transcription regulation, Multigene family, Phosphorylation | 306 | 4274 |
| AK001069 | UPF3A | CDNA FLJ10207 fis, clone HEMBA1005475 | | 307 | 4275 |
| AK001163 | PAICS | phosphoribosylaminoimidazole carboxylase, phosphoribosylaminoimidazole succinocarboxamide synthetase | Multifunctional enzyme, Purine biosynthesis, Ligase, Lyase, Decarboxylase | 308 | 4276 |
| AK001166 | FLJ11252 | HBxAg transactivated protein 1 | Hypothetical protein | 309 | 4277 |
| AK001228 | | chromosome 6 open reading frame 107 | | 310 | 4278 |
| AK001319 | C8FW | phosphoprotein regulated by mitogenic pathways | ATP-binding, Receptor, Transferase | 311 | 4279 |
| AK001362 | ESDN | endothelial and smooth muscle cell-derived neuropilin-like protein | Hypothetical protein | 312 | 4280 |
| AK001394 | | hypothetical protein DKFZp762K222 | | 313 | 4281 |
| AK001452 | FLJ10839 | *Homo sapiens* cDNA FLJ10590 fis, clone NT2RP2004392, weakly similar to MNN4 PROTEIN. | Hypothetical protein | 314 | 4282 |
| AK001469 | GNPNAT1 | glucosamine-phosphate N-acetyltransferase 1 | Hypothetical protein, Transferase | 315 | 4283 |
| AK001478 | ARHU | ras homolog gene family, member U | GTP-binding, Lipoprotein, Prenylation | 316 | 4284 |
| AK001492 | FLJ10637 | hypothetical protein FLJ10637 | Hypothetical protein | 317 | 4285 |
| AK001499 | FLJ10637 | hypothetical protein FLJ10637 | Hypothetical protein | 318 | 4286 |
| AK001503 | | CDNA FLJ10641 fis, clone NT2RP2005748 | Metal-binding, Zinc, Zinc-finger | 319 | 4287 |
| AK001526 | DKFZp667B1218 | hypothetical protein DKFZp667B1218 | Hypothetical protein | 320 | 4288 |
| AK001536 | | Human full-length cDNA 5-PRIME end of clone CS0DK007YB08 of HeLa cells of *Homo sapiens* (human) | Plasmid | 321 | 4289 |
| AK001539 | TEM6 | tensin-like SH2 domain containing 1 | Hypothetical protein | 322 | 4290 |
| AK001565 | AP3M1 | adaptor-related protein complex 3, mu 1 subunit | Golgi stack, Protein transport, Transport, Hypothetical protein | 323 | 4291 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AK001579 | ARAP3 | ARF-GAP, RHO-GAP, ankyrin repeat and plekstrin homology domains-containing protein 3 | Hypothetical protein | 324 | 4292 |
| AK001612 | | hypothetical protein LOC90784 | | 325 | 4293 |
| AK001630 | ETS1 | v-ets erythroblastosis virus E26 oncogene homolog 1 (avian) | Proto-oncogene, Nuclear protein, Transcription regulation, DNA-binding, Phosphorylation, Alternative splicing, 3D-structure | 326 | 4294 |
| AK001731 | MGC17943 | hypothetical protein MGC17943 | Hypothetical protein | 327 | 4295 |
| AK001758 | THOC2 | THO complex 2 | Transport, mRNA transport, mRNA processing, mRNA splicing, Nuclear protein, RNA-binding, Alternative splicing | 328 | 4296 |
| AK001822 | | chromosome 9 open reading frame 37 | Hypothetical protein | 329 | 4297 |
| AK001913 | CL25084 | XTP3-transactivated protein B | Hypothetical protein | 330 | 4298 |
| AK001980 | ADPRTL2 | ADP-ribosyltransferase (NAD+; poly(ADP-ribose) polymerase)-like 2 | Transferase, Glycosyltransferase, NAD, DNA-binding, Nuclear protein, Alternative splicing | 331 | 4299 |
| AK002039 | MRVI1 | murine retrovirus integration site 1 homolog | | 332 | 4300 |
| AK002081 | FLJ10287 | hypothetical protein FLJ10287 | Hypothetical protein | 333 | 4301 |
| AK002141 | PIK4CA | *Homo sapiens* cDNA FLJ11279 fis, clone PLACE1009444, highly similar to PHOSPHATIDYLINOSITOL 4-KINASE ALPHA (EC 2.7.1.67). | Transferase, Kinase | 334 | 4302 |
| AK002146 | | hypothetical protein LOC153684 | | 335 | 4303 |
| AK002174 | KLHL5 | kelch-like 5 (*Drosophila*) | Cytoskeleton, Actin-binding, Repeat, Kelch repeat, Alternative splicing | 336 | 4304 |
| AL049232 | | *Homo sapiens* mRNA; cDNA DKFZp564P1816 (from clone DKFZp564P1816). | | 337 | 4305 |
| AL049266 | | *Homo sapiens* mRNA; cDNA DKFZp564F093 (from clone DKFZp564F093). | | 338 | 4306 |
| AL049279 | | MRNA; cDNA DKFZp564I083 (from clone DKFZp564I083) | | 339 | 4307 |
| AL049299 | DJ465N24.2.1 | hypothetical protein dJ465N24.2.1 | Hypothetical protein | 340 | 4308 |
| AL049309 | SFRS12 | splicing factor, arginine/serine-rich 12 | Nuclear protein, mRNA processing, mRNA splicing, Spliceosome, Alternative splicing | 341 | 4309 |
| AL049365 | FTL | hypothetical protein MGC50853 | Acetylation, Iron storage, Multigene family | 342 | 4310 |
| AL049381 | | pre-B-cell leukemia transcription factor 1 | Transcription regulation, DNA-binding, Nuclear protein, Activator, Repressor, Homeobox, Proto-oncogene, Chromosomal translocation, Alternative splicing, Steroidogenesis, Sexual differentiation, 3D-structure | 343 | 4311 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AL049397 | | CGI-146 protein | Hypothetical protein | 344 | 4312 |
| AL049415 | ADAM19 | a disintegrin and metalloproteinase domain 19 (meltrin beta) | Hydrolase, Metalloprotease, Zinc, Signal, Glycoprotein, Zymogen, Transmembrane, EGF-like domain, SH3-binding, Alternative splicing, Hypothetical protein | 345 | 4313 |
| AL049431 | FLJ20619 | hypothetical protein FLJ20619 | Hypothetical protein | 346 | 4314 |
| AL049450 | | hypothetical protein LOC339287 | | 347 | 4315 |
| AL049471 | | AT rich interactive domain 5B (MRF1-like) | Hypothetical protein | 348 | 4316 |
| AL049962 | | hypothetical protein LOC286148 | | 349 | 4317 |
| AL049963 | LOC64116 | solute carrier family 39 (zinc transporter), member 8 | Hypothetical protein | 350 | 4318 |
| AL050002 | | hypothetical protein LOC169611 | Hypothetical protein | 351 | 4319 |
| AL050021 | | solute carrier family 7 (cationic amino acid transporter, y+ system), member 1 | Hypothetical protein, Transmembrane, Glycoprotein, Transport, Amino-acid transport, Receptor | 352 | 4320 |
| AL050022 | DKFZP564D116 | DKFZP564D116 protein | Hypothetical protein | 353 | 4321 |
| AL050050 | TULIP1 | GTPase activating RANGAP domain-like 2 pseudogene | Hypothetical protein | 354 | 4322 |
| AL050060 | DKFZP566H073 | DKFZP566H073 protein | Hypothetical protein, Metal-binding, Zinc, Zinc-finger | 355 | 4323 |
| AL050091 | GRINL1A | glutamate receptor, ionotropic, N-methyl D-aspartate-like 1A | Hypothetical protein, Receptor | 356 | 4324 |
| AL050126 | LAP1B | lamina-associated polypeptide 1B | Hypothetical protein | 357 | 4325 |
| AL050148 | | sorting nexin 1 | Transport, Protein transport, Golgi stack, Alternative splicing | 358 | 4326 |
| AL050163 | PIK3AP | hematopoietic cell signal transducer | Hypothetical protein, Transmembrane | 359 | 4327 |
| AL050164 | CDYL | chromodomain protein, Y-like | Hypothetical protein, Nuclear protein | 360 | 4328 |
| AL050170 | SLC26A6 | solute carrier family 26, member 6 | Hypothetical protein, Transmembrane, Alternative splicing, Polymorphism | 361 | 4329 |
| AL050173 | C21orf25 | chromosome 21 open reading frame 25 | Hypothetical protein | 362 | 4330 |
| AL050217 | BRD2 | dehydrogenase/reductase (SDR family) member 1 | Oxidoreductase | 363 | 4331 |
| AL050346 | C22orf3 | chromosome 22 open reading frame 3 | Hypothetical protein | 364 | 4332 |
| AL079294 | | MRNA full length insert cDNA clone EUROIMAGE 362780 | Hypothetical protein | 365 | 4333 |
| AL079298 | MCCC2 | methylcrotonoyl-Coenzyme A carboxylase 2 (beta) | Mitochondrion, Transit peptide, Ligase, Disease mutation, Alternative splicing | 366 | 4334 |
| AL080110 | | progestin and adipoQ receptor family member III | Hypothetical protein | 367 | 4335 |
| AL080114 | | chromosome 10 open reading frame 72 | Hypothetical protein | 368 | 4336 |
| AL080125 | ZNF20 | zinc finger protein 20 (KOX 13) | Hypothetical protein, Metal-binding, Nuclear protein, Zinc, Zinc-finger, Transcription regulation, DNA-binding, Repeat | 369 | 4337 |
| AL080156 | DKFZP434J214 | TCDD-inducible poly(ADP-ribose) polymerase | Hypothetical protein | 370 | 4338 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AL080169 | DKFZP434C171 | DKFZP434C171 protein | Hypothetical protein | 371 | 4339 |
| AL080182 | | N-deacetylase/N-sulfotransferase (heparan glucosaminyl) 2 | Hypothetical protein, Transferase, Transmembrane, Glycoprotein, Golgi stack, Signal-anchor | 372 | 4340 |
| AL080192 | | hypothetical protein LOC253782 | Hypothetical protein | 373 | 4341 |
| AL096745 | TBCD | tubulin-specific chaperone d | Hypothetical protein | 374 | 4342 |
| AL109669 | IL16 | interleukin 16 (lymphocyte chemoattractant factor) | Cytokine, Chemotaxis, Repeat, 3D-structure | 375 | 4343 |
| AL109693 | FLJ12587 | hypothetical protein FLJ12587 | Hypothetical protein | 376 | 4344 |
| AL109695 | | solute carrier organic anion transporter family, member 3A1 | Transmembrane, Transport, Ion transport, Glycoprotein | 377 | 4345 |
| AL109699 | | MRNA full length insert cDNA clone EUROIMAGE 375854 | Hypothetical protein | 378 | 4346 |
| AL109705 | | MRNA full length insert cDNA clone EUROIMAGE 73337 | | 379 | 4347 |
| AL109786 | WDR9 | chromosome 21 open reading frame 107 | Bromodomain, Repeat, WD repeat | 380 | 4348 |
| AL109817 | FTCD | formiminotransferase cyclodeaminase | Hypothetical protein, Transferase, Lyase, Histidine metabolism, Multifunctional enzyme, Pyridoxal phosphate, Folate-binding, Alternative splicing, Disease mutation, Polymorphism | 381 | 4349 |
| AL110152 | | CD109 antigen (Gov platelet alloantigens) | Hypothetical protein | 382 | 4350 |
| AL110188 | ZNF10 | zinc finger protein 10 (KOX 1) | Hypothetical protein, Metal-binding, Nuclear protein, Zinc, Zinc-finger, Transcription regulation, DNA-binding, Repeat | 383 | 4351 |
| AL110200 | | *Homo sapiens* mRNA; cDNA DKFZp586B0922 (from clone DKFZp586B0922). | | 384 | 4352 |
| AL110202 | PORIMIN | pro-oncosis receptor inducing membrane injury gene | Hypothetical protein, Receptor, Transmembrane | 385 | 4353 |
| AL110210 | PTPN23 | protein tyrosine phosphatase, non-receptor type 23 | Hydrolase, Hypothetical protein, Receptor | 386 | 4354 |
| AL110218 | SLB | selective LIM binding factor, rat homolog | Hypothetical protein | 387 | 4355 |
| AL110238 | RRN3 | RNA polymerase I transcription factor RRN3 | Initiation factor, Hypothetical protein | 388 | 4356 |
| AL110262 | NCBP2 | nuclear cap binding protein subunit 2, 20 kDa | Transport, mRNA transport, Nuclear protein, RNA-binding, 3D-structure | 389 | 4357 |
| AL110277 | KIAA0916 | protein associated with Myc | Hypothetical protein | 390 | 4358 |
| AL117415 | ADAM33 | *Homo sapiens* mRNA; cDNA DKFZp434K0521 (from clone DKFZp434K0521). | Hypothetical protein, Hydrolase, Metalloprotease, Zinc, Signal, Glycoprotein, Zymogen, Transmembrane, EGF-like domain, Alternative splicing, Integrin, Protease | 391 | 4359 |
| AL117435 | DKFZP434I216 | DKFZP434I216 protein | Hypothetical protein | 392 | 4360 |
| AL117448 | RAB6IP1 | RAB6 interacting protein 1 | Hypothetical protein | 393 | 4361 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AL117452 | FTHFSDC1 | formyltetrahydrofolate synthetase domain containing 1 | Hypothetical protein | 394 | 4362 |
| AL117457 | CFL2 | cofilin 2 (muscle) | Nuclear protein, Actin-binding, Cytoskeleton, Phosphorylation, Alternative splicing | 395 | 4363 |
| AL117458 | IHPK2 | inositol hexaphosphate kinase 2 | Hypothetical protein, Kinase | 396 | 4364 |
| AL117462 | ZFP385 | zinc finger protein 385 | Metal-binding, Zinc, Zinc-finger, Hypothetical protein | 397 | 4365 |
| AL117478 | AGS3 | G-protein signalling modulator 1 (AGS3-like, C. elegans) | Hypothetical protein | 398 | 4366 |
| AL117519 | | hypothetical protein LOC152485 | Hypothetical protein, Metal-binding, Zinc, Zinc-finger | 399 | 4367 |
| AL117573 | DKFZP434F2021 | DKFZP434F2021 protein | Hypothetical protein | 400 | 4368 |
| AL117578 | DKFZP434C128 | chromosome 21 open reading frame 30 | Hypothetical protein | 401 | 4369 |
| AL117609 | DKFZp564O0463 | DKFZP564O0463 protein | Hypothetical protein, Repeat, WD repeat | 402 | 4370 |
| AL117639 | FLJ12890 | CCR4-NOT transcription complex, subunit 10 | Hypothetical protein | 403 | 4371 |
| AL117643 | | activin A receptor, type IB | Receptor, Transferase, Serine/threonine-protein kinase, ATP-binding, Transmembrane, Glycoprotein, Signal, Alternative splicing, Phosphorylation, Polymorphism | 404 | 4372 |
| AL117645 | EG1 | endothelial-derived gene 1 | Hypothetical protein | 405 | 4373 |
| AL117654 | ARH | LDL receptor adaptor protein | Hypothetical protein | 406 | 4374 |
| AL122053 | TRIM3 | tripartite motif-containing 3 | Zinc-finger, Coiled coil, Alternative splicing | 407 | 4375 |
| AL122091 | LOC56965 | hypothetical protein from EUROIMAGE 1977056 | Hypothetical protein | 408 | 4376 |
| AL122097 | FLJ12519 | hypothetical protein FLJ12519 | Hypothetical protein, Repeat, WD repeat | 409 | 4377 |
| AL122098 | NICAL | NEDD9 interacting protein with calponin homology and LIM domains | Hypothetical protein, LIM domain, Metal-binding, Zinc, Cytoskeleton | 410 | 4378 |
| AL122123 | | MRNA; cDNA DKFZp434M038 (from clone DKFZp434M038) | | 411 | 4379 |
| AL133021 | STAB2 | stabilin 2 | EGF-like domain, Laminin EGF-like domain, Hypothetical protein, Receptor | 412 | 4380 |
| AL133071 | DKFZp434I1117 | hypothetical protein DKFZp434I1117 | Hypothetical protein | 413 | 4381 |
| AL133092 | DKFZp434I0428 | dispatched homolog 1 (*Drosophila*) | Hypothetical protein | 414 | 4382 |
| AL133094 | PHF10 | PHD finger protein 10 | Hypothetical protein | 415 | 4383 |
| AL133115 | | cytosolic ovarian carcinoma antigen 1 | Biological rhythms, Electron transport, Growth regulation, Oxidoreductase, NAD, Membrane, Copper, Glycoprotein | 416 | 4384 |
| AL133116 | FKBP10 | *Homo sapiens* mRNA; cDNA DKFZp586I0821 (from clone DKFZp586I0821). | Isomerase, Rotamase, Endoplasmic reticulum, Calcium-binding, Glycoprotein, Phosphorylation, Repeat, Signal, Hypothetical protein | 417 | 4385 |
| AL133117 | | THO complex 2 | Transport, mRNA transport, mRNA processing, mRNA splicing, Nuclear protein, RNA-binding, Alternative splicing | 418 | 4386 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AL133426 | AKAP13 | A kinase (PRKA) anchor protein 13 | Kinase, Receptor, cAMP, Hypothetical protein | 419 | 4387 |
| AL133572 | DKFZp434I0535 | Homo sapiens mRNA; cDNA DKFZp434I0535 (from clone DKFZp434I0535); partial cds. | Hypothetical protein | 420 | 4388 |
| AL133577 | | MRNA; cDNA DKFZp434G0972 (from clone DKFZp434G0972) | | 421 | 4389 |
| AL133580 | SCOC | short coiled-coil protein | Hypothetical protein | 422 | 4390 |
| AL133581 | FLJ25785 | solute carrier family 39 (zinc transporter), member 13 | Hypothetical protein | 423 | 4391 |
| AL133592 | MGC15548 | zinc finger protein 496 | Hypothetical protein, Metal-binding, Zinc, Zinc-finger | 424 | 4392 |
| AL133622 | KIAA0876 | jumonji domain containing 2B | Hypothetical protein | 425 | 4393 |
| AL133632 | DKFZp434E1818 | Similar to hypothetical protein (LOC389822), mRNA | Hypothetical protein, Metal-binding, Zinc, Zinc-finger | 426 | 4394 |
| AL133645 | | hypothetical protein LOC90133 | | 427 | 4395 |
| AL133662 | KIAA0913 | KIAA0913 protein | Hypothetical protein | 428 | 4396 |
| AL136549 | CYFIP2 | cytoplasmic FMR1 interacting protein 2 | Hypothetical protein | 429 | 4397 |
| AL137273 | DKFZP434I0714 | hypothetical protein DKFZP434I0714 | Hypothetical protein | 430 | 4398 |
| AL137298 | DNAJB6 | MRNA; cDNA DKFZp434N2116 (from clone DKFZp434N2116) | Chaperone, Alternative splicing | 431 | 4399 |
| AL137302 | TEX27 | testis expressed sequence 27 | Hypothetical protein | 432 | 4400 |
| AL137397 | FLJ21820 | hypothetical protein FLJ21820 | Hypothetical protein | 433 | 4401 |
| AL137421 | RBM10 | RNA binding motif protein 10 | Hypothetical protein, Metal-binding, Zinc, Zinc-finger, RNA-binding, Nuclear protein, Repeat | 434 | 4402 |
| AL137423 | GU2 | DEAD (Asp-Glu-Ala-Asp) box polypeptide 50 | ATP-binding, Helicase, Hydrolase, Hypothetical protein | 435 | 4403 |
| AL137431 | WBSCR17 | Williams-Beuren syndrome chromosome region 17 | Transferase, Hypothetical protein | 436 | 4404 |
| AL137442 | C20orf177 | chromosome 20 open reading frame 177 | Hypothetical protein | 437 | 4405 |
| AL137473 | C20orf67 | Homo sapiens mRNA; cDNA DKFZp434E1723 (from clone DKFZp434E1723); partial cds. | Alternative splicing, Hypothetical protein | 438 | 4406 |
| AL137477 | CDH24 | cadherin-like 24 | Hypothetical protein, Calcium, Calcium-binding, Cell adhesion, Glycoprotein, Transmembrane, Repeat, Signal, Multigene family, Alternative splicing, Plasmid | 439 | 4407 |
| AL137480 | FNBP4 | formin binding protein 4 | Hypothetical protein | 440 | 4408 |
| AL137491 | | hypothetical protein LOC148696 | | 441 | 4409 |
| AL137509 | DKFZp761A052 | hypothetical protein DKFZp761A052 | Hypothetical protein | 442 | 4410 |
| AL137514 | IHPK2 | inositol hexaphosphate kinase 2 | Hypothetical protein, Kinase | 443 | 4411 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AL137516 | FLJ22059 | zinc finger protein 574 | Hypothetical protein, Metal-binding, Zinc, Zinc-finger, Nuclear protein | 444 | 4412 |
| AL137557 | KIAA1529 | KIAA1529 | Hypothetical protein | 445 | 4413 |
| AL137567 | KIAA1238 | KIAA1238 protein | Hypothetical protein | 446 | 4414 |
| AL137579 | SNX26 | sorting nexin 26 | Hypothetical protein, Transport, Protein transport | 447 | 4415 |
| AL137597 | C20orf110 | chromosome 20 open reading frame 110 |  | 448 | 4416 |
| AL137615 | MKNK2 | MAP kinase-interacting serine/threonine kinase 2 | Hypothetical protein, ATP-binding, Kinase, Serine/threonine-protein kinase, Transferase, Translation regulation, Phosphorylation, Alternative splicing | 449 | 4417 |
| AL137631 | FBXW5 | Homo sapiens mRNA; cDNA DKFZp434B205 (from clone DKFZp434B205); partial cds. | Hypothetical protein, Repeat, WD repeat | 450 | 4418 |
| AL137639 | KIAA0721 | TSPY-like 4 | Hypothetical protein | 451 | 4419 |
| AL137648 | DKFZP434J1813 | ER-resident protein ERdj5 | Redox-active center, Hypothetical protein | 452 | 4420 |
| AL137655 |  | Homo sapiens mRNA; cDNA DKFZp434B2016 (from clone DKFZp434B2016). | Hypothetical protein | 453 | 4421 |
| AL137662 | DKFZp434P086 | hypothetical protein LOC340371 | Hypothetical protein, ATP-binding, Transferase | 454 | 4422 |
| AL137663 | FLJ21791 | pleckstrin homology-like domain, family B, member 2 | Hypothetical protein | 455 | 4423 |
| AL137665 | TUBGCP6 | tubulin, gamma complex associated protein 6 | Microtubule, Repeat, Alternative splicing | 456 | 4424 |
| AL137667 | MAPK8 | Homo sapiens mRNA; cDNA DKFZp434B231 (from clone DKFZp434B231). | Transferase, Serine/threonine-protein kinase, ATP-binding, Phosphorylation, Alternative splicing | 457 | 4425 |
| AL137707 | LOC55901 | TPTE and PTEN homologous inositol lipid phosphatase pseudogene | Signal | 458 | 4426 |
| AL137727 | C14orf9 | chromosome 14 open reading frame 9 | Hypothetical protein, Transmembrane, Alternative splicing | 459 | 4427 |
| AL137733 |  | hypothetical protein LOC284701 | Hypothetical protein | 460 | 4428 |
| AL137736 |  | Rho guanine nucleotide exchange factor (GEF) 19 | Hypothetical protein | 461 | 4429 |
| AL137764 | LOC64744 | hypothetical protein AL133206 | Hypothetical protein | 462 | 4430 |
| AL157432 | TERA | chromosome 12 open reading frame 14 | Hypothetical protein | 463 | 4431 |
| AL157449 | LOC84687 | protein phosphatase 1, regulatory subunit 9B, spinophilin | Hypothetical protein | 464 | 4432 |
| AL157454 | FLJ21313 | HCV NS3-transactivated protein 2 | Hypothetical protein | 465 | 4433 |
| AL157455 |  | Clone IMAGE: 5288750, mRNA |  | 466 | 4434 |
| AL157457 | PP1628 | PH domain-containing protein | Hypothetical protein | 467 | 4435 |
| AL157465 | FLJ20186 | hypothetical protein FLJ20186 | Hypothetical protein | 468 | 4436 |
| AL157480 | SH3BP1 | lectin, galactoside-binding, soluble, 1 (galectin 1) | GTPase activation, SH3-binding, Hypothetical protein, Galectin, Lectin, Multigene family, Acetylation | 469 | 4437 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| AL157484 | | MRNA; cDNA DKFZp762M127 (from clone DKFZp762M127) | | 470 | 4438 |
| AL161960 | FLJ21324 | chromosome 21 open reading frame 97 | Hypothetical protein | 471 | 4439 |
| AL161972 | ICAM2 | hypothetical protein FLJ11724 | 3D-structure, Cell adhesion, Glycoprotein, Immunoglobulin domain, Repeat, Signal, Transmembrane | 472 | 4440 |
| AL161977 | PCTK3 | PCTAIRE protein kinase 3 | Hypothetical protein, ATP-binding, Kinase, Serine/threonine-protein kinase, Transferase | 473 | 4441 |
| AL161983 | | hypothetical protein MGC39820 | | 474 | 4442 |
| AL161994 | HEI10 | cyclin B1 interacting protein 1 | Ubl conjugation pathway, Ligase, Nuclear protein, Metal-binding, Zinc, Coiled coil, Zinc-finger, Phosphorylation, Ubl conjugation | 475 | 4443 |
| AL162013 | PLXNA1 | *Homo sapiens* mRNA; cDNA DKFZp761P19121 (from clone DKFZp761P19121); partial cds. | Hypothetical protein | 476 | 4444 |
| AL162039 | | MOB1, Mps One Binder kinase activator-like 1A (yeast) | | 477 | 4445 |
| AL162062 | LOC91010 | formin-like 3 | Hypothetical protein | 478 | 4446 |
| AL353934 | MUS81 | MUS81 endonuclease homolog (yeast) | Endonuclease, Hypothetical protein | 479 | 4447 |
| AL353952 | PI4KII | phosphatidylinositol 4-kinase type II | Hypothetical protein, Kinase | 480 | 4448 |
| AL353953 | FLJ13055 | lipid phosphate phosphatase-related protein type 2 | Hypothetical protein | 481 | 4449 |
| AL355708 | NEO1 | neogenin homolog 1 (chicken) | Cell adhesion, Repeat, Signal, Transmembrane, Immunoglobulin domain, Glycoprotein, Alternative splicing | 482 | 4450 |
| AW190932_RC | GPI | xl66g09.x1 NCI_CGAP_Pan1 *Homo sapiens* cDNA clone IMAGE: 2679712 3', mRNA sequence. | Gluconeogenesis, Glycolysis, Isomerase, Growth factor, Cytokine, Disease mutation, 3D-structure, Hypothetical protein | 483 | 4451 |
| AW273216_RC | | ring finger protein 149 | Hypothetical protein, Metal-binding, Zinc, Zinc-finger | 484 | 4452 |
| AW419203_RC | KIAA0601 | amine oxidase (flavin containing) domain 2 | Hypothetical protein | 485 | 4453 |
| AW673036_RC | PPP1R3B | hypothetical protein LOC286044 | Hypothetical protein | 486 | 4454 |
| BE671663_RC | EVIN2 | epidermodysplasia verruciformis 2 | Transmembrane, Hypothetical protein | 487 | 4455 |
| BE672528_RC | | cyclin-dependent kinase 6 | | 488 | 4456 |
| Contig10037_RC | | hypothetical protein DKFZp667C165 | Hypothetical protein | 489 | 4457 |
| Contig1007_RC | LOC51754 | hypothetical protein LOC283070 | Hypothetical protein | 490 | 4458 |
| Contig10162_RC | MGC14276 | hypothetical protein MGC14276 | Hypothetical protein | 491 | 4459 |
| Contig1030_RC | FLJ00026 | dedicator of cytokinesis 8 | Guanine-nucleotide releasing factor | 492 | 4460 |
| Contig10363_RC | MRF2 | AT rich interactive domain 5B (MRF1-like) | Hypothetical protein | 493 | 4461 |
| Contig10373_RC | | hypothetical protein MGC21854 | Hypothetical protein | 494 | 4462 |
| Contig10418_RC | | Transcribed sequences | | 495 | 4463 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig10429_RC | DKFZp434H2111 | hypothetical protein DKFZp434H2111 | Hypothetical protein | 496 | 4464 |
| Contig10531_RC | | microtubule-associated protein tau | Microtubule, Cytoskeleton, Repeat, Alternative splicing, Acetylation, Phosphorylation, Glycoprotein, Polymorphism, Disease mutation, Alzheimer's disease, 3D-structure, Hypothetical protein | 497 | 4465 |
| Contig1056_RC | LOC57106 | K562 cell-derived leucine-zipper-like protein 1 | Hypothetical protein | 498 | 4466 |
| Contig1061_RC | | KIAA0924 protein | Hypothetical protein, Metal-binding, Nuclear protein, Zinc, Zinc-finger | 499 | 4467 |
| Contig10629_RC | PERQ1 | PERQ amino acid rich, with GYF domain 1 | Hypothetical protein | 500 | 4468 |
| Contig1063_RC | TRIM33 | Homo sapiens cDNA FLJ35131 fis, clone PLACE6008824. | Hypothetical protein | 501 | 4469 |
| Contig10670_RC | | Transcribed sequences | | 502 | 4470 |
| Contig10690_RC | | spleen tyrosine kinase | Transferase, Tyrosine-protein kinase, ATP-binding, Phosphorylation, SH2 domain, Repeat, Alternative splicing, 3D-structure | 503 | 4471 |
| Contig10750_RC | | Transcribed sequences | | 504 | 4472 |
| Contig10844_RC | | CDNA FLJ31150 fis, clone IMR322001534 | Hypothetical protein | 505 | 4473 |
| Contig11012_RC | | leukocyte-derived arginine aminopeptidase | Aminopeptidase | 506 | 4474 |
| Contig11075_RC | NFASC | neurofascin | Cell adhesion, Repeat, Signal, Transmembrane, Immunoglobulin domain, Glycoprotein, Alternative splicing, Polymorphism, Hypothetical protein | 507 | 4475 |
| Contig11266_RC | | Transcribed sequence with moderate similarity to protein ref: NP_054848.1 (H. sapiens) PRO0478 protein [Homo sapiens] | | 508 | 4476 |
| Contig112_RC | | NICE-4 protein | Hypothetical protein | 509 | 4477 |
| Contig1146_RC | LOC90550 | chromosome 10 open reading frame 42 | Hypothetical protein | 510 | 4478 |
| Contig11_RC | | hypothetical protein LOC90462 | Hypothetical protein | 511 | 4479 |
| Contig12140_RC | | Transcribed sequences | | 512 | 4480 |
| Contig12201_RC | | splicing factor, arginine/serine-rich 5 | Nuclear protein, RNA-binding, mRNA splicing, Alternative splicing, Repeat, Phosphorylation, Polymorphism, Plasmid | 513 | 4481 |
| Contig12540_RC | | Transcribed sequences | | 514 | 4482 |
| Contig12750_RC | | hypothetical protein LOC257106 | Hypothetical protein | 515 | 4483 |
| Contig12755_RC | GCN1L1 | homeodomain interacting protein kinase 2 | Transferase, Serine/threonine-protein kinase, ATP-binding, Nuclear protein, Alternative splicing | 516 | 4484 |
| Contig12820_RC | FLJ21709 | nucleotide-binding oligomerization domains 27 | Hypothetical protein | 517 | 4485 |
| Contig12855 | MAPK8IP2 | MRNA; cDNA DKFZp434J0428 (from clone DKFZp434J0428) | Kinase, SH3 domain, Alternative splicing | 518 | 4486 |

NICE-4

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig1295_RC | MDS033 | protein F25965 | Transmembrane, Golgi stack, Endoplasmic reticulum | 519 | 4487 |
| Contig13165_RC | B4GALT6 | UDP-Gal:betaGlcNAc beta 1,4-galactosyltransferase, polypeptide 6 | Transferase, Glycosyltransferase, Glycoprotein, Transmembrane, Signal-anchor, Golgi stack, Manganese, Magnesium, Calcium, Multigene family | 520 | 4488 |
| Contig13387_RC | FLJ21458 | hypothetical protein FLJ21458 | Hypothetical protein | 521 | 4489 |
| Contig13480_RC | | Transcribed sequences | | 522 | 4490 |
| Contig13510_RC | | zinc finger protein 325 | Hypothetical protein, Metal-binding, Nuclear protein, Zinc, Zinc-finger, Transcription regulation, DNA-binding, Repeat | 523 | 4491 |
| Contig13609_RC | | Transcribed sequences | | 524 | 4492 |
| Contig13643_RC | | Transcribed sequences | | 525 | 4493 |
| Contig1366_RC | DC-TM4F2 | tetraspanin similar to TM4SF9 | Hypothetical protein, Transmembrane | 526 | 4494 |
| Contig13766_RC | | Transcribed sequences | | 527 | 4495 |
| Contig1386_RC | SEMA4B | sema domain, immunoglobulin domain (Ig), transmembrane domain (TM) and short cytoplasmic domain, (semaphorin) 4B | Transmembrane, Immunoglobulin domain, Multigene family, Neurogenesis, Developmental protein, Glycoprotein, Signal, Polymorphism | 528 | 4496 |
| Contig1389_RC | ITPR1 | mitogen-activated protein kinase 9 | ATP-binding, Kinase, Transferase, Serine/threonine-protein kinase, Phosphorylation, Alternative splicing | 529 | 4497 |
| Contig14039_RC | FOXE3 | forkhead box E3 | Transcription regulation, DNA-binding, Nuclear protein | 530 | 4498 |
| Contig1403_RC | LBH | likely ortholog of mouse limb-bud and heart gene | Hypothetical protein | 531 | 4499 |
| Contig14172 | | vitelliform macular dystrophy (Best disease, bestrophin) | Iron storage, Iron, Metal-binding, 3D-structure, Transport, Ion transport, Ionic channel, Chloride channel, Calcium, Alternative splicing, Disease mutation, Polymorphism, Vision, Transmembrane, Phosphorylation | 532 | 4500 |
| Contig14197_RC | | Transcribed sequences | | 533 | 4501 |
| Contig1422_RC | | hypothetical protein FLJ38426 | Hypothetical protein | 534 | 4502 |
| Contig14282_RC | | Transcribed sequences | | 535 | 4503 |
| Contig14433_RC | | Transcribed sequences | | 536 | 4504 |
| Contig1447_RC | EFG1 | mitochondrial elongation factor G1 | Elongation factor, Protein biosynthesis, Mitochondrion, Transit peptide, GTP-binding | 537 | 4505 |
| Contig14520_RC | | Transcribed sequences | | 538 | 4506 |
| Contig14555_RC | | Transcribed sequences | | 539 | 4507 |
| Contig14581_RC | | Transcribed sequences | | 540 | 4508 |
| Contig14625_RC | FLJ22021 | hypothetical protein FLJ22021 | Repeat, WD repeat | 541 | 4509 |
| Contig1462_RC | C11orf15 | chromosome 11 open reading frame 15 | Transmembrane | 542 | 4510 |
| Contig14658_RC | | zx08b09.s1 Soares_total_fetus_Nb2HF8_9w *Homo sapiens* cDNA clone IMAGE: 785849 3', mRNA sequence. | | 543 | 4511 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig14720_RC | | Transcribed sequences | | 544 | 4512 |
| Contig14797_RC | | Transcribed sequences | | 545 | 4513 |
| Contig14899_RC | LOC146853 | LOC146853 | | 546 | 4514 |
| Contig1505_RC | MGC4308 | hypothetical protein MGC4308 | | 547 | 4515 |
| Contig151_RC | ELKS | CDNA FLJ31750 fis, clone NT2RI2007406 | Hypothetical protein | 548 | 4516 |
| Contig15267_RC | | Transcribed sequences | | 549 | 4517 |
| Contig15281_RC | | Chediak-Higashi syndrome 1 | Protein transport, Transport, Repeat, WD repeat, Disease mutation, Alternative splicing | 550 | 4518 |
| Contig1540_RC | ACTB | serine palmitoyltransferase, long chain base subunit 2 | Transferase, Acyltransferase, Transmembrane, Pyridoxal phosphate, Endoplasmic reticulum | 551 | 4519 |
| Contig15580_RC | | LOC401124 (LOC401124), mRNA | | 552 | 4520 |
| Contig15607_RC | | Transcribed sequences | | 553 | 4521 |
| Contig15635_RC | | Transcribed sequences | | 554 | 4522 |
| Contig15647_RC | | Transcribed sequences | | 555 | 4523 |
| Contig15674_RC | | Transcribed sequences | | 556 | 4524 |
| Contig15898_RC | | Transcribed sequence with weak similarity to protein ref: NP_055301.1 (*H. sapiens*) neuronal thread protein [*Homo sapiens*] | | 557 | 4525 |
| Contig16192_RC | | Transcribed sequence with moderate similarity to protein ref: NP_110386.1 (*H. sapiens*) nuclear receptor binding factor-2 [*Homo sapiens*] | | 558 | 4526 |
| Contig1619_RC | NAPB | N-ethylmaleimide-sensitive factor attachment protein, beta | Hypothetical protein | 559 | 4527 |
| Contig1620_RC | PPP1R16A | protein phosphatase 1, regulatory (inhibitor) subunit 16A | ANK repeat, Repeat, Coiled coil, Lipoprotein, Prenylation, Membrane | 560 | 4528 |
| Contig16217_RC | | Transcribed sequences | | 561 | 4529 |
| Contig1632_RC | MGC17921 | chromosome 14 open reading frame 31 | Alternative splicing | 562 | 4530 |
| Contig16376_RC | DKFZP564B1162 | hypothetical protein DKFZp564B1162 | Hypothetical protein | 563 | 4531 |
| Contig16437_RC | | Transcribed sequences | | 564 | 4532 |
| Contig16440_RC | | Transcribed sequences | | 565 | 4533 |
| Contig16441_RC | | Transcribed sequences | | 566 | 4534 |
| Contig16447_RC | C16orf44 | chromosome 16 open reading frame 44 | Hypothetical protein | 567 | 4535 |
| Contig16530_RC | | Transcribed sequences | | 568 | 4536 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig16736_RC | | Clone IMAGE: 5561763, mRNA | Hypothetical protein | 569 | 4537 |
| Contig16772_RC | | Transcribed sequences | | 570 | 4538 |
| Contig16786_RC | | Transcribed sequences | | 571 | 4539 |
| Contig1682_RC | RCP | Rab coupling protein | Hypothetical protein | 572 | 4540 |
| Contig16908_RC | MGC42174 | hypothetical protein MGC42174 | Hypothetical protein | 573 | 4541 |
| Contig16931_RC | YR-29 | TGF beta-inducible nuclear protein 1 | Nuclear protein | 574 | 4542 |
| Contig1699_RC | FLJ12438 | hypothetical protein FLJ12438 | Hypothetical protein | 575 | 4543 |
| Contig17017_RC | | Transcribed sequences | | 576 | 4544 |
| Contig17084_RC | | DEAD (Asp-Glu-Ala-Asp) box polypeptide 31 | ATP-binding, Helicase, Hydrolase, Hypothetical protein | 577 | 4545 |
| Contig17109_RC | | Similar to Protein C20orf27 (LOC390690), mRNA | | 578 | 4546 |
| Contig17356_RC | | hypothetical protein FLJ13611 | Hypothetical protein | 579 | 4547 |
| Contig17607_RC | | Transcribed sequences | | 580 | 4548 |
| Contig1789_RC | LAGY | homeodomain-only protein | Hypothetical protein, DNA-binding, Homeobox, Nuclear protein | 581 | 4549 |
| Contig178_RC | | syntrophin, beta 2 (dystrophin-associated protein A1, 59 kDa, basic component 2) | Actin-binding, Cytoskeleton, Microtubule, Calcium-binding, Calmodulin-binding, Membrane, Phosphorylation, Repeat, Polymorphism, Multigene family, Alternative splicing | 582 | 4550 |
| Contig17982_RC | | hypothetical protein FLJ14624 | Hypothetical protein | 583 | 4551 |
| Contig1798_RC | MOX2 | antigen identified by monoclonal antibody MRC OX-2 | Antigen, Neurone, T-cell, Signal, Transmembrane, Immunoglobulin domain, Glycoprotein, Alternative splicing | 584 | 4552 |
| Contig18246_RC | | oz78a12.x1 Soares_senescent_fibroblasts_NbHSF *Homo sapiens* cDNA clone IMAGE: 1681438 3', mRNA sequence. | | 585 | 4553 |
| Contig18286_RC | | pellino 3 alpha | Alternative splicing | 586 | 4554 |
| Contig18476_RC | | *Homo sapiens*, clone IMAGE: 4830091, mRNA. | | 587 | 4555 |
| Contig18493_RC | | oj35b09.s1 NCI_CGAP_Lu5 *Homo sapiens* cDNA clone IMAGE: 1500281 3', mRNA sequence. | | 588 | 4556 |
| Contig18504_RC | OR52K3P | olfactory receptor, family 52, subfamily K, member 3 pseudogene | Hypothetical protein | 589 | 4557 |
| Contig19023_RC | | yf45a10.s2 Soares fetal liver spleen 1NFLS *Homo sapiens* cDNA clone IMAGE: 129786 3', mRNA sequence. | | 590 | 4558 |
| Contig19064_RC | | hypothetical protein LOC340351 | | 591 | 4559 |
| Contig19127_RC | FLJ31295 | hypothetical protein FLJ31295 | Metal-binding, Zinc, Zinc-finger, Hypothetical protein | 592 | 4560 |
| Contig19210_RC | | Transcribed sequences | | 593 | 4561 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig1924_RC | C20orf11 | chromosome 20 open reading frame 11 | Coiled coil | 594 | 4562 |
| Contig19333_RC | | Transcribed sequences | | 595 | 4563 |
| Contig1951 | GNPAT | MRNA; cDNA DKFZp686J23256 (from clone DKFZp686J23256) | Transferase, Acyltransferase, Peroxisome, Membrane, Rhizomelic chondrodysplasia punctata, Disease mutation | 596 | 4564 |
| Contig19700_RC | | Transcribed sequences | | 597 | 4565 |
| Contig19715_RC | | Transcribed sequences | | 598 | 4566 |
| Contig1990_RC | LOC92799 | hypothetical protein BC007653 | Repeat, WD repeat, Hypothetical protein | 599 | 4567 |
| Contig19918_RC | | Transcribed sequences | | 600 | 4568 |
| Contig1991_RC | PGA5 | pepsinogen 5, group I (pepsinogen A) | Hydrolase, Aspartyl protease, Digestion, Zymogen, Signal, Phosphorylation, 3D-structure, Polymorphism | 601 | 4569 |
| Contig19931_RC | | Transcribed sequences | | 602 | 4570 |
| Contig20370_RC | | Transcribed sequences | | 603 | 4571 |
| Contig20391_RC | | Transcribed sequence with strong similarity to protein pir: EFHU1 (*H. sapiens*) EFHU1 translation elongation factor eEF-1 alpha-1 chain — human | | 604 | 4572 |
| Contig20427_RC | | Transcribed sequences | | 605 | 4573 |
| Contig20600_RC | | CDNA FLJ34654 fis, clone KIDNE2018294 | | 606 | 4574 |
| Contig20617_RC | | CDNA FLJ34031 fis, clone FCBBF2003895 | | 607 | 4575 |
| Contig20830_RC | | *Homo sapiens* cDNA FLJ13550 fis, clone PLACE1007111. | | 608 | 4576 |
| Contig20843_RC | | Transcribed sequences | | 609 | 4577 |
| Contig20864_RC | FLJ22529 | hypothetical protein FLJ22529 | Hypothetical protein | 610 | 4578 |
| Contig20913_RC | FLJ12785 | hypothetical protein FLJ12785 | Hypothetical protein | 611 | 4579 |
| Contig20979_RC | | hypothetical protein MGC35555 | | 612 | 4580 |
| Contig21098_RC | | Msx-interacting-zinc finger | Multigene family, Zinc-finger, Nuclear protein, DNA-binding, Metal-binding, Alternative splicing | 613 | 4581 |
| Contig21116_RC | | Transcribed sequences | | 614 | 4582 |
| Contig21200_RC | | Transcribed sequences | | 615 | 4583 |
| Contig21268_RC | | Similar to hypothetical protein FLJ35867 (LOC342357), mRNA | | 616 | 4584 |
| Contig2143_RC | KIAA1771 | dedicator of cytokinesis 7 | Hypothetical protein, Guanine-nucleotide releasing factor, Alternative splicing | 617 | 4585 |
| Contig21627_RC | | CDNA FLJ39637 fis, clone SMINT2003003 | Hypothetical protein | 618 | 4586 |
| Contig21787_RC | | Transcribed sequences | | 619 | 4587 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig2179_RC | FLJ32452 | hypothetical protein FLJ32452 | Hypothetical protein | 620 | 4588 |
| Contig21839_RC | | ow70g11.s1 Soares_fetal_liver_spleen_1NFLS_S1 *Homo sapiens* cDNA clone IMAGE: 1652228 3', mRNA sequence. | | 621 | 4589 |
| Contig21847_RC | KSP37 | Ksp37 protein | | 622 | 4590 |
| Contig21891_RC | FLJ13231 | hypothetical protein FLJ13231 | Hypothetical protein | 623 | 4591 |
| Contig21904 | | immunoglobulin superfamily, member 2 | | 624 | 4592 |
| Contig21997_RC | | Transcribed sequences | | 625 | 4593 |
| Contig22003_RC | | Transcribed sequences | | 626 | 4594 |
| Contig22025_RC | FLJ10111 | v-akt murine thymoma viral oncogene homolog 1 | Hypothetical protein, ATP-binding, Transferase, Serine/threonine-protein kinase, Phosphorylation, Nuclear protein, Kinase | 627 | 4595 |
| Contig22418_RC | PTP4A3 | protein tyrosine phosphatase type IVA, member 3 | | 628 | 4596 |
| Contig22526_RC | | Transcribed sequences | | 629 | 4597 |
| Contig22551_RC | | Transcribed sequences | | 630 | 4598 |
| Contig2263_RC | KIAA1949 | KIAA1949 | Hypothetical protein | 631 | 4599 |
| Contig22844_RC | DKFZp434H2111 | hypothetical protein DKFZp434H2111 | Hypothetical protein | 632 | 4600 |
| Contig22901_RC | | AGENCOURT_6640943 NIH_MGC_99 *Homo sapiens* cDNA clone IMAGE: 5434077 5', mRNA sequence. | | 633 | 4601 |
| Contig23240_RC | | hypothetical protein FLJ12525 | Hypothetical protein | 634 | 4602 |
| Contig23263_RC | NR5A1 | *Homo sapiens* cDNA FLJ33539 fis, clone BRAMY2007610, highly similar to STEROIDOGENIC FACTOR 1. | Receptor, Transcription regulation, DNA-binding, Nuclear protein, Zinc-finger, Disease mutation, Hypothetical protein | 635 | 4603 |
| Contig23280 | | lecithin-cholesterol acyltransferase | Cholesterol metabolism, Lipid metabolism, Transferase, Acyltransferase, Signal, Glycoprotein, Polymorphism, Disease mutation | 636 | 4604 |
| Contig23299_RC | P5 | BTG3 associated nuclear protein | Hypothetical protein | 637 | 4605 |
| Contig2339_RC | FLJ21032 | stearoyl-CoA desaturase 4 | Hypothetical protein | 638 | 4606 |
| Contig23423_RC | | Transcribed sequences | | 639 | 4607 |
| Contig23525_RC | KIAA0140 | similar to CG9643-PA | Hypothetical protein | 640 | 4608 |
| Contig23547_RC | | Clone IMAGE: 5214442, mRNA | | 641 | 4609 |
| Contig23593_RC | | Transcribed sequences | | 642 | 4610 |
| Contig23604_RC | | carnitine O-octanoyltransferase | Transferase, Acyltransferase, Fatty acid metabolism, Transport, Peroxisome | 643 | 4611 |
| Contig23667_RC | | WD repeat and HMG-box DNA binding protein 1 | Nuclear protein, DNA-binding, Repeat, WD repeat | 644 | 4612 |
| Contig24090 | | CDNA FLJ37425 fis, clone BRAWH2001530 | | 645 | 4613 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig24094_RC | | CDNA FLJ30598 fis, clone BRAWH2009263 | | 646 | 4614 |
| Contig24098_RC | | glutamate receptor, ionotropic, N-methyl D-aspartate 2D | Receptor, Signal, Transmembrane, Postsynaptic membrane, Calcium, Glycoprotein, Ionic channel, Magnesium | 647 | 4615 |
| Contig2429_RC | | FLJ40142 protein | Hypothetical protein | 648 | 4616 |
| Contig24450_RC | | Transcribed sequences | | 649 | 4617 |
| Contig24453_RC | | Transcribed sequences | | 650 | 4618 |
| Contig24600_RC | | Transcribed sequences | | 651 | 4619 |
| Contig25041_RC | | yx89b03.s1 Soares melanocyte 2NbHM *Homo sapiens* cDNA clone IMAGE: 268877 3', mRNA sequence. | | 652 | 4620 |
| Contig25058_RC | | Transcribed sequences | | 653 | 4621 |
| Contig2505_RC | GLTP | glycolipid transfer protein | Transport, Lipid transport, Repeat, Acetylation | 654 | 4622 |
| Contig25107_RC | | ferredoxin 1 | Metal-binding, Iron-sulfur, Iron, 2Fe—2S, Electron transport, Mitochondrion, Transit peptide | 655 | 4623 |
| Contig25126_RC | | Transcribed sequences | | 656 | 4624 |
| Contig2531_RC | FLJ12484 | hypothetical protein FLJ12484 | Hypothetical protein | 657 | 4625 |
| Contig25332_RC | GDF11 | cytokine induced protein 29 kDa | Nuclear protein, DNA-binding, Transcription, Transcription regulation, Translation regulation | 658 | 4626 |
| Contig25362_RC | DKFZP566A1524 | hypothetical protein DKFZp566A1524 | Hypothetical protein | 659 | 4627 |
| Contig25429_RC | | Transcribed sequences | | 660 | 4628 |
| Contig25435_RC | FLJ10803 | hypothetical protein FLJ10803 | Hypothetical protein | 661 | 4629 |
| Contig2544 | FLJ11526 | hypothetical protein FLJ11526 | Hypothetical protein | 662 | 4630 |
| Contig25546_RC | CCT6A | itchy homolog E3 ubiquitin protein ligase (mouse) | Ubl conjugation pathway, Ligase, Nuclear protein, Repeat, Phosphorylation, Alternative splicing | 663 | 4631 |
| Contig25595_RC | KIAA1618 | KIAA1618 | Hypothetical protein | 664 | 4632 |
| Contig256 | PSMD11 | wt73b11.x1 Soares_thymus_NHFTh *Homo sapiens* cDNA clone IMAGE: 2513085 3' similar to TR: Q26195 Q26195 PVA1 GENE.; mRNA sequence. | Proteasome | 665 | 4633 |
| Contig25610_RC | | CDNA FLJ31796 fis, clone NT2RI2008841 | | 666 | 4634 |
| Contig25744_RC | | Transcribed sequences | | 667 | 4635 |
| Contig2576_RC | DKFZP564O1664 | hypothetical protein DKFZp564O1664 | Hypothetical protein | 668 | 4636 |
| Contig25770_RC | | Clone IMAGE: 4817413, mRNA | | 669 | 4637 |
| Contig25783_RC | | Clone IMAGE: 5555626, mRNA | | 670 | 4638 |
| Contig2578_RC | ORF1-FL49 | putative nuclear protein ORF1-FL49 | Nuclear protein | 671 | 4639 |
| Contig25827_RC | FLJ13848 | hypothetical protein FLJ13848 | Hypothetical protein | 672 | 4640 |
| Contig2584_RC | | ribonuclease P (14 kD) | Hydrolase, Nuclear protein, tRNA processing | 673 | 4641 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig25861_RC | | Transcribed sequences | | 674 | 4642 |
| Contig25960_RC | DKFZP564B0769 | chromosome 6 open reading frame 111 | Hypothetical protein | 675 | 4643 |
| Contig26014_RC | SYTL3 | synaptotagmin-like 3 | | 676 | 4644 |
| Contig26019_RC | | methionyl aminopeptidase 2 | Aminopeptidase, Hypothetical protein, Hydrolase, Cobalt, 3D-structure | 677 | 4645 |
| Contig26059_RC | | Transcribed sequences | | 678 | 4646 |
| Contig2608 | SLC2A4RG | SLC2A4 regulator | Transcription regulation, DNA-binding, Nuclear protein, Zinc-finger, Metal-binding, Alternative splicing | 679 | 4647 |
| Contig26170_RC | | Transcribed sequences | | 680 | 4648 |
| Contig26332_RC | | Transcribed sequences | | 681 | 4649 |
| Contig263_RC | MGC12435 | chromosome 14 open reading frame 168 | | 682 | 4650 |
| Contig26405_RC | TSLL2 | immunoglobulin superfamily, member 4C | Immunoglobulin domain | 683 | 4651 |
| Contig26416_RC | | Transcribed sequences | | 684 | 4652 |
| Contig26461_RC | | Transcribed sequences | | 685 | 4653 |
| Contig2647_RC | BCAT1 | branched chain aminotransferase 1, cytosolic | Transferase, Aminotransferase, Hypothetical protein, Branched-chain amino acid biosynthesis, Pyridoxal phosphate | 686 | 4654 |
| Contig2648_RC | MGC15407 | similar to RIKEN cDNA 4931428D14 gene | | 687 | 4655 |
| Contig2657_RC | MGC16207 | hypothetical protein MGC16207 | Hypothetical protein | 688 | 4656 |
| Contig26622_RC | BIC | BIC transcript | | 689 | 4657 |
| Contig26706_RC | | CDNA FLJ43676 fis, clone SYNOV4009129 | | 690 | 4658 |
| Contig26998_RC | | WD repeat domain 1 | Repeat, WD repeat, Actin-binding, Cytoskeleton, Alternative splicing, Polymorphism, Hypothetical protein | 691 | 4659 |
| Contig27060_RC | | Transcribed sequence with moderate similarity to protein pdb: 1LBG (*E. coli*) B Chain B, Lactose Operon Repressor Bound To 21-Base Pair Symmetric Operator Dna, Alpha Carbons Only | | 692 | 4660 |
| Contig27084_RC | | CDNA FLJ45493 fis, clone BRTHA2008598 | | 693 | 4661 |
| Contig27124_RC | | CDNA FLJ42250 fis, clone TKIDN2007828 | | 694 | 4662 |
| Contig27145_RC | | Transcribed sequences | | 695 | 4663 |
| Contig27228_RC | | amyloid beta (A4) precursor protein-binding, family B, member 1 interacting protein | Hypothetical protein | 696 | 4664 |
| Contig2728_RC | | zinc finger protein 596 | Hypothetical protein, Metal-binding, Zinc, Zinc-finger | 697 | 4665 |
| Contig27338_RC | | Transcribed sequences | | 698 | 4666 |
| Contig27386_RC | C7orf13 | chromosome 7 open reading frame 13 | | 699 | 4667 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig27542_RC | | Transcribed sequences | | 700 | 4668 |
| Contig27558_RC | FLJ13163 | MRNA; cDNA DKFZp779J2459 (from clone DKFZp779J2459) | Hypothetical protein, Kinase | 701 | 4669 |
| Contig27725_RC | | Transcribed sequences | | 702 | 4670 |
| Contig27765_RC | | potassium inwardly-rectifying channel, subfamily J, member 15 | Hypothetical protein, Ionic channel, Ion transport, Voltage-gated channel, Transmembrane, Potassium transport | 703 | 4671 |
| Contig27776_RC | | hypothetical protein FLJ21106 | Hypothetical protein | 704 | 4672 |
| Contig27797_RC | | DnaJ (Hsp40) homolog, subfamily A, member 2 | Chaperone, Repeat, Zinc, Metal-binding, Prenylation, Lipoprotein, Membrane, Multigene family | 705 | 4673 |
| Contig27820_RC | | Transcribed sequences | | 706 | 4674 |
| Contig27837_RC | | Transcribed sequence with weak similarity to protein ref: NP_060265.1 (*H. sapiens*) hypothetical protein FLJ20378 [*Homo sapiens*] | | 707 | 4675 |
| Contig27896_RC | | HSPC009 protein | | 708 | 4676 |
| Contig27915_RC | MGC40042 | hypothetical protein MGC40042 | Hypothetical protein | 709 | 4677 |
| Contig27977_RC | | Transcribed sequences | | 710 | 4678 |
| Contig28024_RC | KIAA0955 | caspase recruitment domain family, member 8 | Apoptosis, Nuclear protein, Alternative splicing, Hypothetical protein | 711 | 4679 |
| Contig28050_RC | | *Homo sapiens* cDNA FLJ35764 fis, clone TESTI2004906, weakly similar to *H. sapiens* mRNA for SIRP-beta1. | | 712 | 4680 |
| Contig2811_RC | C8orf2 | *Homo sapiens* mRNA; cDNA DKFZp667H242 (from clone DKFZp667H242); complete cds. | Transmembrane, Alternative splicing | 713 | 4681 |
| Contig28164_RC | | Transcribed sequences | | 714 | 4682 |
| Contig28181_RC | | ns17h07.s1 NCI_CGAP_GCB1 *Homo sapiens* cDNA clone IMAGE: 1183933 3', mRNA sequence. | | 715 | 4683 |
| Contig28229_RC | | Transcribed sequences | | 716 | 4684 |
| Contig2823_RC | FLJ23499 | chromosome 11 open reading frame 1 | Hypothetical protein | 717 | 4685 |
| Contig28286_RC | | Transcribed sequences | | 718 | 4686 |
| Contig28298_RC | NUP62 | UI-H-Bl0p-abm-b-04-0-UI.s1 NCI_CGAP_Sub2 *Homo sapiens* cDNA clone IMAGE: 2712150 3', mRNA sequence. | Nuclear protein, Transport, Glycoprotein, Coiled coil, Repeat, Polymorphism | 719 | 4687 |
| Contig28522_RC | | Clone 24653 mRNA sequence | | 720 | 4688 |
| Contig28567_RC | | Transcribed sequences | | 721 | 4689 |
| Contig2857_RC | DKFZp761G2113 | hypothetical protein DKFZp761G2113 | Hypothetical protein | 722 | 4690 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig28707_RC | ADAMTS13 | a disintegrin-like and metalloprotease (reprolysin type) with thrombospondin type 1 motif, 13 | Protease, Hypothetical protein, Signal | 723 | 4691 |
| Contig28760_RC | | cyclin-dependent kinase 6 | | 724 | 4692 |
| Contig28766_RC | | Transcribed sequences | | 725 | 4693 |
| Contig28787_RC | | hypothetical protein LOC120526 | Hypothetical protein | 726 | 4694 |
| Contig2883_RC | RALY | Clone IMAGE: 5285100, mRNA | Ribonucleoprotein, RNA-binding, Nuclear protein, Antigen, Alternative splicing, Polymorphism | 727 | 4695 |
| Contig28947_RC | CDC25A | cell division cycle 25A | Cell division, Mitosis, Hydrolase, Alternative splicing, Multigene family, 3D-structure, Hypothetical protein | 728 | 4696 |
| Contig28949 | | Clone IMAGE: 5268292, mRNA | | 729 | 4697 |
| Contig28996_RC | | NHL repeat containing 1 | | 730 | 4698 |
| Contig29171_RC | | CDNA FLJ11544 fis, clone HEMBA1002826 | | 731 | 4699 |
| Contig29207_RC | | chromosome 20 open reading frame 78 | | 732 | 4700 |
| Contig29284_RC | | Transcribed sequences | | 733 | 4701 |
| Contig292_RC | FLJ22386 | leucine zipper domain protein | Hypothetical protein | 734 | 4702 |
| Contig2930_RC | DAB2 | CDNA FLJ35517 fis, clone SPLEN2000698 | Alternative splicing, Phosphorylation | 735 | 4703 |
| Contig29349_RC | | Transcribed sequences | | 736 | 4704 |
| Contig29362_RC | | hypothetical protein LOC338692 | Hypothetical protein | 737 | 4705 |
| Contig29373_RC | | 24b2/STAC2 protein | | 738 | 4706 |
| Contig29569_RC | | hypothetical protein MGC29898 | Hypothetical protein | 739 | 4707 |
| Contig29732_RC | | hypothetical protein LOC338758 | | 740 | 4708 |
| Contig29749_RC | LOC85028 | PNAS-123 | | 741 | 4709 |
| Contig29780_RC | | Transcribed sequences | | 742 | 4710 |
| Contig29802_RC | | programmed cell death 6 | Calcium-binding, Repeat, Apoptosis | 743 | 4711 |
| Contig29860_RC | NFAM1 | NFAT activation molecule 1 | Hypothetical protein, Signal, Transmembrane, Immunoglobulin domain, Phosphorylation | 744 | 4712 |
| Contig2986_RC | EEG1 | C1q domain containing 1 | Hypothetical protein | 745 | 4713 |
| Contig29887_RC | DKFZp434J0617 | hypothetical protein DKFZp434J0617 | Hypothetical protein | 746 | 4714 |
| Contig29890_RC | FLJ32449 | ankyrin repeat domain 23 | Hypothetical protein, ANK repeat, Repeat | 747 | 4715 |
| Contig29901_RC | | proteasome (prosome, macropain) subunit, alpha type, 3 | Proteasome, Hydrolase, Protease, Acetylation, Alternative splicing, Phosphorylation, Threonine protease | 748 | 4716 |
| Contig29921_RC | FLJ22570 | Dok-like protein | Hypothetical protein | 749 | 4717 |
| Contig29940_RC | CMYA1 | cardiomyopathy associated 1 | Hypothetical protein | 750 | 4718 |
| Contig29954_RC | CATSPER2 | Clone IMAGE: 5294645, mRNA | | 751 | 4719 |
| Contig29955_RC | | zj86d08.s1 Soares_fetal_liver_spleen_1NFLS_S1 Homo sapiens cDNA clone IMAGE: 461775 3', mRNA sequence. | | 752 | 4720 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig29995_RC | | Transcribed sequences | | 753 | 4721 |
| Contig30052_RC | C18B11 | C18B11 homolog (44.9 kD) | Hypothetical protein | 754 | 4722 |
| Contig30109_RC | PRKWNK4 | protein kinase, lysine deficient 4 | Hypothetical protein, ATP-binding, Transferase, Kinase, Serine/threonine-protein kinase | 755 | 4723 |
| Contig30154_RC | | Transcribed sequence with moderate similarity to protein sp: P39194 (*H. sapiens*) ALU7_HUMAN Alu subfamily SQ sequence contamination warning entry | | 756 | 4724 |
| Contig3015_RC | | pleckstrin homology domain containing, family A (phosphoinositide binding specific) member 2 | | 757 | 4725 |
| Contig30209_RC | FLJ12649 | hypothetical protein FLJ12649 | Hypothetical protein | 758 | 4726 |
| Contig30378_RC | FLJ10178 | hypothetical protein FLJ10178 | Hypothetical protein | 759 | 4727 |
| Contig30474_RC | VIT | vitrin | Hypothetical protein | 760 | 4728 |
| Contig30484_RC | | Transcribed sequences | | 761 | 4729 |
| Contig30496_RC | ZNF219 | LOC400176 (LOC387957), mRNA | Transcription regulation, DNA-binding, Zinc-finger, Metal-binding, Nuclear protein, Repeat | 762 | 4730 |
| Contig30736_RC | | Transcribed sequences | | 763 | 4731 |
| Contig30811_RC | PRKRA | MRNA; cDNA DKFZp686G1498 (from clone DKFZp686G1498) | Kinase | 764 | 4732 |
| Contig30840_RC | LOC63929 | hypothetical protein LOC63929 | Hypothetical protein | 765 | 4733 |
| Contig30934_RC | MGC33993 | hypothetical protein MGC33993 | Hypothetical protein, Metal-binding, Zinc, Zinc-finger | 766 | 4734 |
| Contig3094_RC | PINK1 | PTEN induced putative kinase 1 | Hypothetical protein, ATP-binding, Kinase, Serine/threonine-protein kinase, Transferase | 767 | 4735 |
| Contig30977_RC | | hypothetical protein LOC154790 | | 768 | 4736 |
| Contig30989_RC | MGC10744 | hypothetical protein MGC10744 | Hypothetical protein | 769 | 4737 |
| Contig31057_RC | | Transcribed sequences | | 770 | 4738 |
| Contig31186_RC | HNRPDL | heterogeneous nuclear ribonucleoprotein D-like | Nucleocapsid, Ribonucleoprotein | 771 | 4739 |
| Contig31361_RC | | dedicator of cytokinesis 7 | Hypothetical protein, Guanine-nucleotide releasing factor, Alternative splicing | 772 | 4740 |
| Contig31366_RC | LNPEP | hypothetical protein FLJ39485 | Hypothetical protein | 773 | 4741 |
| Contig31421_RC | | thyroid hormone receptor interactor 12 | Proteasome, Ubl conjugation pathway, Ligase | 774 | 4742 |
| Contig31449_RC | | Transcribed sequence with weak similarity to protein sp: P39195 (*H. sapiens*) ALU8_HUMAN Alu subfamily SX sequence contamination warning entry | | 775 | 4743 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig3147_RC | MUM2 | trafficking protein particle complex 1 | Transport, Endoplasmic reticulum, Golgi stack, Disease mutation | 776 | 4744 |
| Contig31482_RC | | Transcribed sequences | | 777 | 4745 |
| Contig31495 | | thyroid hormone receptor interactor 11 | Antigen, Golgi stack, Coiled coil, Chromosomal translocation, Hypothetical protein | 778 | 4746 |
| Contig31513_RC | | Transcribed sequences | | 779 | 4747 |
| Contig31525_RC | | Transcribed sequence with weak similarity to protein ref: NP_079364.1 (*H. sapiens*) hypothetical protein FLJ13241 [*Homo sapiens*] | | 780 | 4748 |
| Contig31587_RC | | Human full-length cDNA 5-PRIME end of clone CS0DK007YB08 of HeLa cells of *Homo sapiens* (human) | Plasmid | 781 | 4749 |
| Contig31597_RC | PDE4DIP | chromosome 1 amplified sequence 3 | Hypothetical protein | 782 | 4750 |
| Contig31661_RC | | hypothetical protein FLJ10385 | Hypothetical protein, Repeat, WD repeat | 783 | 4751 |
| Contig31664_RC | MGC26979 | hypothetical protein MGC26979 | Hypothetical protein | 784 | 4752 |
| Contig31699_RC | | CDNA FLJ27273 fis, clone TMS00761 | | 785 | 4753 |
| Contig31740_RC | PFN1 | hypothetical protein LOC285345 | Metal-binding, Zinc, Zinc-finger, Transcription regulation, DNA-binding, Nuclear protein, Repeat | 786 | 4754 |
| Contig31864_RC | | FERM domain containing 3 | Hypothetical protein | 787 | 4755 |
| Contig31906_RC | | similar to hypothetical protein FLJ13659 | Hypothetical protein | 788 | 4756 |
| Contig31911_RC | | hypothetical protein LOC349136 | Hypothetical protein | 789 | 4757 |
| Contig32027_RC | | CDNA FLJ46867 fis, clone UTERU3012293, weakly similar to *Homo sapiens* zinc finger protein 14 (KOX 6) (ZNF14) | | 790 | 4758 |
| Contig32059_RC | MGC17919 | zinc finger and BTB domain containing 8 | Zinc, Hypothetical protein, Metal-binding, Zinc-finger | 791 | 4759 |
| Contig32081_RC | | Full length insert cDNA clone YP77A07 | | 792 | 4760 |
| Contig32103_RC | | Clone IMAGE: 4689481, mRNA | | 793 | 4761 |
| Contig32123_RC | | Similar to ataxin 2 binding protein 1 isoform gamma; hexaribonucleotide binding protein 1 (LOC339162), mRNA | | 794 | 4762 |
| Contig32185_RC | | intimal thickness-related receptor | | 795 | 4763 |
| Contig3228_RC | VMP1 | hypothetical protein LOC283680 | Hypothetical protein | 796 | 4764 |
| Contig32322_RC | | quaking homolog, KH domain RNA binding (mouse) | Hypothetical protein | 797 | 4765 |
| Contig32323_RC | | hypothetical protein FLJ13105 | Hypothetical protein | 798 | 4766 |
| Contig32335_RC | | Transcribed sequences | | 799 | 4767 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig32377_RC | | ubiquitin specific protease 51 | Protease | 800 | 4768 |
| Contig32431_RC | | Transcribed sequences | | 801 | 4769 |
| Contig3250_RC | LOC92399 | mitochondrial ribosome recycling factor | Hypothetical protein | 802 | 4770 |
| Contig32540_RC | | Transcribed sequences | | 803 | 4771 |
| Contig32550_RC | ZFP93 | zinc finger protein 235 | Transcription regulation, DNA-binding, Zinc-finger, Metal-binding, Nuclear protein, Repeat | 804 | 4772 |
| Contig32637_RC | | RAB27A, member RAS oncogene family | GTP-binding, Lipoprotein, Prenylation, Alternative splicing, Disease mutation | 805 | 4773 |
| Contig32757 | FLJ21069 | hypothetical protein FLJ21069 | Hypothetical protein, ANK repeat, Repeat | 806 | 4774 |
| Contig32825_RC | | polymerase (RNA) III (DNA directed) (32 kD) | | 807 | 4775 |
| Contig32920 | FUBP1 | nexilin (F actin binding protein) | Hypothetical protein | 808 | 4776 |
| Contig33062_RC | | chromosome 17 open reading frame 31 | Hypothetical protein | 809 | 4777 |
| Contig3311_RC | MGC13186 | hypothetical protein MGC13186 | Hypothetical protein, ATP-binding | 810 | 4778 |
| Contig33127_RC | | Sequence 161 from Patent WO0220754. | | 811 | 4779 |
| Contig3313 | FLJ23153 | likely ortholog of mouse tumor necrosis-alpha-induced adipose-related protein | Hypothetical protein | 812 | 4780 |
| Contig33188_RC | | Transcribed sequences | | 813 | 4781 |
| Contig33207_RC | | Transcribed sequences | | 814 | 4782 |
| Contig33224_RC | | Transcribed sequences | | 815 | 4783 |
| Contig33273_RC | | chromodomain helicase DNA binding protein 1-like | DNA-binding, Helicase, Hypothetical protein, ATP-binding, Hydrolase | 816 | 4784 |
| Contig33331_RC | MKI67IP | MKI67 (FHA domain) interacting nucleolar phosphoprotein | | 817 | 4785 |
| Contig33334_RC | | Transcribed sequences | | 818 | 4786 |
| Contig33369_RC | | Transcribed sequence with weak similarity to protein ref: NP_062553.1 (*H. sapiens*) hypothetical protein FLJ11267 [*Homo sapiens*] | | 819 | 4787 |
| Contig33394_RC | FLJ37318 | ubiquitin specific protease 54 | Hypothetical protein | 820 | 4788 |
| Contig3344 | MGC2835 | DEAD (Asp-Glu-Ala-Asp) box polypeptide 54 | ATP-binding, Helicase, Hydrolase, Hypothetical protein | 821 | 4789 |
| Contig33442_RC | | MOB1, Mps One Binder kinase activator-like 2A (yeast) | Hypothetical protein | 822 | 4790 |
| Contig33464_RC | | Similar to bA304I5.1 (novel lipase) (LOC340654), mRNA | | 823 | 4791 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig33540_RC | SEMA3F | ob92d09.s1 NCI_CGAP_GCB1 Homo sapiens cDNA clone IMAGE: 1338833 3', mRNA sequence. | Signal, Immunoglobulin domain, Multigene family, Glycoprotein, Polymorphism | 824 | 4792 |
| Contig33574_RC | | Transcribed sequences | | 825 | 4793 |
| Contig3359_RC | | neuralized-like (Drosophila) | Hypothetical protein | 826 | 4794 |
| Contig33703_RC | FLJ21438 | hypothetical protein FLJ21438 | Hypothetical protein | 827 | 4795 |
| Contig33741_RC | FLJ12428 | DEP domain containing 6 | Hypothetical protein | 828 | 4796 |
| Contig33760_RC | | chromosome 9 open reading frame 71 | | 829 | 4797 |
| Contig33790_RC | | jun dimerization protein 2 | DNA-binding, Nuclear protein | 830 | 4798 |
| Contig33810_RC | FLJ31528 | hypothetical protein FLJ31528 | Hypothetical protein | 831 | 4799 |
| Contig33831_RC | | Transcribed sequences | | 832 | 4800 |
| Contig33852_RC | OPRL1 | opiate receptor-like 1 | G-protein coupled receptor, Transmembrane, Glycoprotein, Phosphorylation, Lipoprotein, Palmitate, Alternative splicing | 833 | 4801 |
| Contig33888_RC | | ow44c09.x1 Soares_parathyroid_tumor_NbHPA Homo sapiens cDNA clone IMAGE: 1649680 3', mRNA sequence. | | 834 | 4802 |
| Contig3390_RC | FLJ12619 | chromosome 6 open reading frame 62 | Hypothetical protein | 835 | 4803 |
| Contig33951_RC | | nuclear pore complex protein | Nuclear protein, Transport | 836 | 4804 |
| Contig33967_RC | | Transcribed sequences | | 837 | 4805 |
| Contig33987 | | hypothetical protein KIAA1109 | Hypothetical protein | 838 | 4806 |
| Contig33996_RC | | Transcribed sequences | | 839 | 4807 |
| Contig34019_RC | MGC15827 | hypothetical protein MGC15827 | Hypothetical protein | 840 | 4808 |
| Contig34051_RC | | Transcribed sequences | | 841 | 4809 |
| Contig34090_RC | | Transcribed sequences | | 842 | 4810 |
| Contig340_RC | PPP1R15B | protein phosphatase 1, regulatory (inhibitor) subunit 15B | Hypothetical protein | 843 | 4811 |
| Contig34118_RC | | Transcribed sequences | | 844 | 4812 |
| Contig34231_RC | | yd77f12.s1 Soares fetal liver spleen 1NFLS Homo sapiens cDNA clone IMAGE: 114287 3', mRNA sequence. | | 845 | 4813 |
| Contig34286_RC | | Transcribed sequences | | 846 | 4814 |
| Contig34291_RC | | nuclear receptor subfamily 3, group C, member 1 (glucocorticoid receptor) | Transcription regulation, Receptor, Trans-acting factor, Nuclear protein, DNA-binding, Steroid-binding, Zinc-finger, Phosphorylation, Ubl conjugation, Alternative initiation, Alternative splicing, Polymorphism, Disease mutation | 847 | 4815 |
| Contig34302_RC | | hypothetical protein LOC150166 | | 848 | 4816 |
| Contig34303_RC | SFXN5 | sideroflexin 5 | Transport, Iron transport, Iron, Mitochondrion, Transmembrane | 849 | 4817 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig34350_RC | | CDNA FLJ45384 fis, clone BRHIP3021987 | | 850 | 4818 |
| Contig34470_RC | | similar to kinesin family member 21A; N-5 kinesin | Hypothetical protein | 851 | 4819 |
| Contig34554_RC | | CDNA FLJ33367 fis, clone BRACE2005661 | | 852 | 4820 |
| Contig34593_RC | | Transcribed sequences | | 853 | 4821 |
| Contig34607_RC | | ym49g02.s1 Soares infant brain 1NIB *Homo sapiens* cDNA clone IMAGE: 51586 3', mRNA sequence. | | 854 | 4822 |
| Contig34634_RC | GCN1L1 | homeodomain interacting protein kinase 2 | Transferase, Serine/threonine-protein kinase, ATP-binding, Nuclear protein, Alternative splicing | 855 | 4823 |
| Contig34672_RC | | Transcribed sequences | | 856 | 4824 |
| Contig3474_RC | | CDNA: FLJ22541 fis, clone HSI00130 | | 857 | 4825 |
| Contig34768_RC | | chromosome 21 open reading frame 59 | Hypothetical protein | 858 | 4826 |
| Contig34779_RC | | SH3-domain kinase binding protein 1 | SH3 domain, Repeat, Membrane, Nuclear protein, Coiled coil, Polymorphism, Alternative splicing | 859 | 4827 |
| Contig34880_RC | | Transcribed sequences | | 860 | 4828 |
| Contig3495_RC | MGC45416 | hypothetical protein MGC45416 | Hypothetical protein | 861 | 4829 |
| Contig34983_RC | | Transcribed sequences | | 862 | 4830 |
| Contig34998_RC | TMLHE | CDNA FLJ25895 fis, clone CBR03553 | Hypothetical protein | 863 | 4831 |
| Contig34999_RC | | periplakin | Keratinization, Repeat, Coiled coil, Cytoskeleton, Structural protein | 864 | 4832 |
| Contig35002_RC | FLJ12994 | hypothetical protein FLJ12994 | Hypothetical protein | 865 | 4833 |
| Contig35018_RC | | zr44a03.s1 Soares_NhHMPu_S1 *Homo sapiens* cDNA clone IMAGE: 666220 3', mRNA sequence. | | 866 | 4834 |
| Contig35043 | | Transcribed sequences | | 867 | 4835 |
| Contig35052_RC | | pituitary tumor-transforming 1 interacting protein | Transmembrane, Nuclear protein | 868 | 4836 |
| Contig35076_RC | | Sequence 226 from Patent WO0220754. | | 869 | 4837 |
| Contig35094_RC | FLJ21478 | NOD9 protein | Hypothetical protein | 870 | 4838 |
| Contig35163_RC | | Similar to hypothetical protein MG11009.4 (LOC285344), mRNA | | 871 | 4839 |
| Contig35182_RC | | qb88b05.x1 Soares_fetal_heart_NbHH19W *Homo sapiens* cDNA clone IMAGE: 1707153 3', mRNA sequence. | | 872 | 4840 |
| Contig35187_RC | ARL4 | ADP-ribosylation factor-like 4 | GTP-binding, Multigene family, Nuclear protein | 873 | 4841 |
| Contig35251_RC | | CDNA: FLJ22719 fis, clone HSI14307 | | 874 | 4842 |
| Contig35425_RC | | hypothetical protein LOC285831 | Hypothetical protein | 875 | 4843 |
| Contig35435_RC | FLJ23447 | hypothetical protein FLJ23447 | Hypothetical protein | 876 | 4844 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig35576_RC | | Transcribed sequences | | 877 | 4845 |
| Contig35608_RC | | df54a02.y1 Morton Fetal Cochlea *Homo sapiens* cDNA clone IMAGE: 2487051 5', mRNA sequence. | | 878 | 4846 |
| Contig35635_RC | TAGAP | T-cell activation GTPase activating protein | Hypothetical protein | 879 | 4847 |
| Contig35661_RC | DSCR1L2 | Down syndrome critical region gene 1-like 2 | Alternative splicing | 880 | 4848 |
| Contig35685_RC | FLJ13117 | spermatogenesis associated, serine-rich 2 | Hypothetical protein | 881 | 4849 |
| Contig35700_RC | | CDNA clone IMAGE: 6702802, partial cds | | 882 | 4850 |
| Contig35713_RC | | FIS | | 883 | 4851 |
| Contig35799_RC | | centaurin, beta 2 | GTPase activation, Repeat, ANK repeat, Zinc-finger | 884 | 4852 |
| Contig35874_RC | | Transcribed sequences | | 885 | 4853 |
| Contig35896_RC | | signal transducer and activator of transcription 3 interacting protein 1 | Hypothetical protein, Repeat, WD repeat | 886 | 4854 |
| Contig35940 | KIAA1733 | RPEL repeat containing 1 | Hypothetical protein | 887 | 4855 |
| Contig35958_RC | MGC13071 | hypothetical protein MGC13071 | Hypothetical protein, Metal-binding, Nuclear protein, Zinc, Zinc-finger | 888 | 4856 |
| Contig35976_RC | | family with sequence similarity 3, member C | Signal | 889 | 4857 |
| Contig3597_RC | LENG5 | leukocyte receptor cluster (LRC) member 5 | Receptor, Hypothetical protein | 890 | 4858 |
| Contig36020_RC | MGC15634 | hypothetical protein MGC15634 | Hypothetical protein | 891 | 4859 |
| Contig36075_RC | | Transcribed sequences | | 892 | 4860 |
| Contig36104_RC | CCT6A | Iaa10b09.x1 8 5 week embryo anterior tongue 8 5 EAT *Homo sapiens* cDNA 3', mRNA sequence. | Chaperone, ATP-binding, Multigene family | 893 | 4861 |
| Contig36106_RC | NCL | hypothetical protein LOC157697 | Hypothetical protein | 894 | 4862 |
| Contig36125_RC | | Transcribed sequences | | 895 | 4863 |
| Contig36129_RC | MGC4707 | hypothetical protein LOC283989 | Hypothetical protein | 896 | 4864 |
| Contig3612_RC | KIAA1802 | chromosome 13 open reading frame 8 | Hypothetical protein, Metal-binding, Zinc, Zinc-finger | 897 | 4865 |
| Contig36152_RC | | sterile alpha motif domain containing 6 | Hypothetical protein, ANK repeat, Repeat | 898 | 4866 |
| Contig36169_RC | DKFZp547E052 | hypothetical protein DKFZp547E052 | Hypothetical protein | 899 | 4867 |
| Contig36178_RC | | sialyltransferase 9 (CMP-NeuAc:lactosylceramide alpha-2,3-sialyltransferase; GM3 synthase) | Transferase, Glycosyltransferase, Glycoprotein, Transmembrane, Signal-anchor, Golgi stack | 900 | 4868 |
| Contig36190_RC | | Transcribed sequences | | 901 | 4869 |
| Contig36193_RC | | inositol 1,4,5-triphosphate receptor, type 1 | Receptor, Transmembrane, Phosphorylation, Ionic channel, Ion transport, Calcium channel | 902 | 4870 |
| Contig36195_RC | | Full length insert cDNA clone ZD73D05 | | 903 | 4871 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig3626_RC | FLJ13855 | hypothetical protein FLJ13855 | Hypothetical protein, Ligase, Ubl conjugation pathway | 904 | 4872 |
| Contig36323_RC | SFXN5 | sideroflexin 5 | Transport, Iron transport, Iron, Mitochondrion, Transmembrane | 905 | 4873 |
| Contig36359_RC | | Transcribed sequences | | 906 | 4874 |
| Contig36369_RC | | we24d02.x1 NCI_CGAP_Lu24 *Homo sapiens* cDNA clone IMAGE: 2342019 3', mRNA sequence. | | 907 | 4875 |
| Contig36409_RC | | Transcribed sequences | | 908 | 4876 |
| Contig36512_RC | | Transcribed sequences | | 909 | 4877 |
| Contig36525 | ARX | aristaless related homeobox | Homeobox, DNA-binding, Developmental protein, Nuclear protein, Transcription regulation, Disease mutation, Triplet repeat expansion, Epilepsy | 910 | 4878 |
| Contig36617_RC | | chromosome 6 open reading frame 182 | | 911 | 4879 |
| Contig36622_RC | | Transcribed sequences | | 912 | 4880 |
| Contig36628 | | HANP1 | | 913 | 4881 |
| Contig36634_RC | FLJ39514 | sec1 family domain containing 2 | Hypothetical protein | 914 | 4882 |
| Contig36720_RC | | Transcribed sequences | | 915 | 4883 |
| Contig36761_RC | FLJ23403 | hypothetical protein FLJ23403 | Hypothetical protein | 916 | 4884 |
| Contig36803_RC | FLJ13952 | sorting nexin 22 | Hypothetical protein, Transport, Protein transport | 917 | 4885 |
| Contig36805_RC | MGC15435 | zinc finger, BED domain containing 3 | Zinc-finger | 918 | 4886 |
| Contig36810 | | CDNA FLJ37425 fis, clone BRAWH2001530 | | 919 | 4887 |
| Contig36876_RC | | *Homo sapiens* cDNA FLJ32044 fis, clone NTONG2000985. | | 920 | 4888 |
| Contig36879_RC | | Clone IMAGE: 4753714, mRNA | | 921 | 4889 |
| Contig36888_RC | | suppression of tumorigenicity 7 like | Hypothetical protein | 922 | 4890 |
| Contig36939_RC | | Transcribed sequences | | 923 | 4891 |
| Contig3695_RC | MGC17330 | HGFL gene | Hypothetical protein, Glycoprotein, Kringle | 924 | 4892 |
| Contig36973_RC | AGMAT | *Homo sapiens* cDNA: FLJ23384 fis, clone HEP16468. | Putrescine biosynthesis, Spermidine biosynthesis, Hydrolase, Manganese, Mitochondrion, Transit peptide | 925 | 4893 |
| Contig36976_RC | DIBD1 | disrupted in bipolar affective disorder 1 | Hypothetical protein | 926 | 4894 |
| Contig36997_RC | bioref | zinc finger protein 481 | Transcription regulation, DNA-binding, Zinc-finger, Metal-binding, Nuclear protein, Repeat | 927 | 4895 |
| Contig37016_RC | ING5 | inhibitor of growth family, member 5 | Hypothetical protein | 928 | 4896 |
| Contig37025_RC | | CDNA FLJ41484 fis, clone BRTHA2003030 | | 929 | 4897 |
| Contig37029_RC | FLJ23153 | likely ortholog of mouse tumor necrosis-alpha-induced adipose-related protein | Hypothetical protein | 930 | 4898 |
| Contig37037_RC | | chromosome 13 open reading frame 25 | | 931 | 4899 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig37082_RC | MGC2408 | hypothetical protein MGC2408 | Hypothetical protein | 932 | 4900 |
| Contig37140_RC | | membrane protein, palmitoylated 7 (MAGUK p55 subfamily member 7) | Hypothetical protein, SH3 domain | 933 | 4901 |
| Contig37142_RC | | Homo sapiens cDNA FLJ12163 fis, clone MAMMA1000594. | | 934 | 4902 |
| Contig37219 | MDN1 | MDN1, midasin homolog (yeast) | Chaperone, ATP-binding, Repeat, Nuclear protein | 935 | 4903 |
| Contig37262 | | Clone IMAGE: 5263527, mRNA | Hypothetical protein | 936 | 4904 |
| Contig37300_RC | KIAA1904 | KIAA1904 protein | Hypothetical protein | 937 | 4905 |
| Contig37306_RC | MUC16 | mucin 16 | Hypothetical protein | 938 | 4906 |
| Contig3734_RC | RPS8 | Clone IMAGE: 4249217, mRNA | Ribosomal protein | 939 | 4907 |
| Contig37361_RC | | Transcribed sequences | | 940 | 4908 |
| Contig37364_RC | | Transcribed sequences | | 941 | 4909 |
| Contig37368_RC | | nemo like kinase | ATP-binding, Kinase, Serine/threonine-protein kinase, Transferase | 942 | 4910 |
| Contig37569_RC | | CDNA FLJ26339 fis, clone HRT02975 | | 943 | 4911 |
| Contig37660_RC | ADAM6 | a disintegrin and metalloproteinase domain 6 | | 944 | 4912 |
| Contig37736_RC | RAD1 | Transcribed sequence with moderate similarity to protein ref: NP_060312.1 (H. sapiens) hypothetical protein FLJ20489 [Homo sapiens] | Hypothetical protein, Ribosome biogenesis, Nuclear protein, Cell cycle, Exonuclease | 945 | 4913 |
| Contig37763_RC | | Transcribed sequence with moderate similarity to protein ref: NP_002945.1 (H. sapiens) ubiquitin and ribosomal protein S27a precursor; ubiquitin carboxyl extension protein 80; 40S ribosomal protein S27a; ubiquitin; ubiquitin-CEP80 [Homo sapiens] | | 946 | 4914 |
| Contig37764_RC | | qa65f01.x1 Soares_fetal_heart_NbHH19W Homo sapiens cDNA clone IMAGE: 1691641 3', mRNA sequence. | | 947 | 4915 |
| Contig37895_RC | | yh88d01.s1 Soares placenta Nb2HP Homo sapiens cDNA clone IMAGE: 136801 3', mRNA sequence. | | 948 | 4916 |
| Contig37950_RC | | qz91d12.x1 Soares_pregnant_uterus_NbHPU Homo sapiens cDNA clone IMAGE: 2041943 3', mRNA sequence. | | 949 | 4917 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig37958 | KAI1 | hypothetical protein LOC284023 | Glycoprotein, Transmembrane, Antigen | 950 | 4918 |
| Contig37991_RC | LOC133308 | hypothetical protein BC009732 | Hypothetical protein | 951 | 4919 |
| Contig38043_RC | | hypothetical protein LOC199675 | | 952 | 4920 |
| Contig38093_RC | | Transcribed sequences | | 953 | 4921 |
| Contig380_RC | KIAA1724 | selenoprotein I, 1 | Hypothetical protein, Transferase, Transmembrane, Selenium, Selenocysteine | 954 | 4922 |
| Contig38117_RC | | Transcribed sequences | | 955 | 4923 |
| Contig38155_RC | | Transcribed sequences | | 956 | 4924 |
| Contig38169_RC | FLJ13984 | hypothetical protein FLJ13984 | Hypothetical protein | 957 | 4925 |
| Contig3820_RC | LOC56898 | dehydrogenase/reductase (SDR family) member 6 | Oxidoreductase, Hypothetical protein | 958 | 4926 |
| Contig38285_RC | FLJ10462 | male sterility domain containing 1 | Hypothetical protein | 959 | 4927 |
| Contig38288_RC | DKFZp762A2013 | quiescin Q6-like 1 | Hypothetical protein, Signal | 960 | 4928 |
| Contig382_RC | NLI-IF | CTD (carboxy-terminal domain, RNA polymerase II, polypeptide A) small phosphatase 1 | Hypothetical protein, Nuclear protein | 961 | 4929 |
| Contig38320_RC | | Transcribed sequences | | 962 | 4930 |
| Contig38321_RC | | Transcribed sequences | | 963 | 4931 |
| Contig3834_RC | | MRNA; cDNA DKFZp686K14148 (from clone DKFZp686K14148) | | 964 | 4932 |
| Contig38398_RC | | Transcribed sequences | | 965 | 4933 |
| Contig38493_RC | | CDNA FLJ42010 fis, clone SPLEN2032036 | | 966 | 4934 |
| Contig38581_RC | | anaphase promoting complex subunit 1 | Ubl conjugation pathway, Cell cycle, Cell division, Mitosis, Repeat | 967 | 4935 |
| Contig38603_RC | | Transcribed sequences | | 968 | 4936 |
| Contig38604_RC | | CDNA FLJ25042 fis, clone CBL03351 | Hypothetical protein | 969 | 4937 |
| Contig38654_RC | | solute carrier family 28 (sodium-coupled nucleoside transporter), member 3 | | 970 | 4938 |
| Contig38669_RC | HS2ST1 | heparan sulfate 2-O-sulfotransferase 1 | Hypothetical protein, Transferase | 971 | 4939 |
| Contig38714_RC | | Transcribed sequences | | 972 | 4940 |
| Contig38721_RC | MGC35163 | sterile alpha motif domain containing 3 | Hypothetical protein | 973 | 4941 |
| Contig38724_RC | | Clone IMAGE: 5275753, mRNA | | 974 | 4942 |
| Contig38726_RC | | SWI/SNF related, matrix associated, actin dependent regulator of chromatin, subfamily e, member 1 | Hypothetical protein | 975 | 4943 |
| Contig38731_RC | | frizzled homolog 2 (*Drosophila*) | Multigene family, G-protein coupled receptor, Transmembrane, Developmental protein, Wnt signaling pathway, Glycoprotein, Signal | 976 | 4944 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig38778 | TRIM7 | tripartite motif-containing 7 | Zinc-finger, Zinc, Coiled coil, Metal-binding, Polymorphism, Alternative splicing | 977 | 4945 |
| Contig38803_RC | | Rho GTPase activating protein 1 | GTPase activation, SH3-binding, 3D-structure | 978 | 4946 |
| Contig38877 | | zv94e09.s1 Soares_NhHMPu_S1 *Homo sapiens* cDNA clone IMAGE: 767464 3', mRNA sequence. | | 979 | 4947 |
| Contig38944_RC | | Transcribed sequences | | 980 | 4948 |
| Contig39008_RC | MYCL1 | v-myc myelocytomatosis viral oncogene homolog 1, lung carcinoma derived (avian) | Nuclear protein, DNA-binding, Proto-oncogene | 981 | 4949 |
| Contig39043_RC | | zl77f02.s1 Stratagene colon (#937204) *Homo sapiens* cDNA clone IMAGE: 510651 3', mRNA sequence. | | 982 | 4950 |
| Contig39048_RC | | TAFA2 protein | Hypothetical protein | 983 | 4951 |
| Contig39116_RC | a1/3GTP | alpha-1,3-galactosyltransferase pseudogene | Glycosyltransferase, Transferase | 984 | 4952 |
| Contig3920_RC | SP1 | Sp1 transcription factor | Hypothetical protein, Transcription regulation, Activator, Zinc-finger, Metal-binding, DNA-binding, Nuclear protein, Repeat, Glycoprotein, 3D-structure | 985 | 4953 |
| Contig39236 | FLJ00026 | Homo sapiens, Similar to RIKEN cDNA 5830472H07 gene, clone MGC: 39702 IMAGE: 5271738, mRNA, complete cds. | Hypothetical protein, Guanine-nucleotide releasing factor | 986 | 4954 |
| Contig39249 | THBS3 | thrombospondin 3 | Glycoprotein, Cell adhesion, Calcium-binding, Repeat, EGF-like domain, Signal | 987 | 4955 |
| Contig39287_RC | | Transcribed sequence with moderate similarity to protein pir: E54024 (*H. sapiens*) E54024 protein kinase | | 988 | 4956 |
| Contig39297_RC | LOC148898 | hypothetical protein BC007899 | Hypothetical protein | 989 | 4957 |
| Contig39364_RC | UPF3B | UPF3 regulator of nonsense transcripts homolog B (yeast) | | 990 | 4958 |
| Contig39403_RC | | hypothetical protein FLJ34790 | Hypothetical protein | 991 | 4959 |
| Contig3940_RC | C9orf19 | chromosome 9 open reading frame 19 | Hypothetical protein | 992 | 4960 |
| Contig39448_RC | | N-acetylneuraminate pyruvate lyase (dihydrodipicolinate synthase) | | 993 | 4961 |
| Contig39496_RC | FLJ22501 | Hermansky-Pudlak syndrome 6 | Hypothetical protein | 994 | 4962 |
| Contig39545_RC | MTIF3 | general transcription factor IIIA | Transcription regulation, Zinc-finger, Metal-binding, DNA-binding, RNA-binding, Repeat, Nuclear protein, Polymorphism | 995 | 4963 |
| Contig39603_RC | CNOT3 | CCR4-NOT transcription complex, subunit 3 | Hypothetical protein | 996 | 4964 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig39626_RC | STK35 | serine/threonine kinase 35 | Hypothetical protein, Transferase, Serine/threonine-protein kinase, ATP-binding, Phosphorylation | 997 | 4965 |
| Contig39702_RC | | similar to Putative protein C21orf56 | Hypothetical protein | 998 | 4966 |
| Contig39739_RC | CDK9 | Full length insert cDNA clone ZA91F08 | Transferase, Serine/threonine-protein kinase, ATP-binding, Nuclear protein, Polymorphism | 999 | 4967 |
| Contig39797_RC | TRIPIN | tripin | Hypothetical protein | 1000 | 4968 |
| Contig39810_RC | | hypothetical protein MGC43690 | Hypothetical protein | 1001 | 4969 |
| Contig39878_RC | BOP | SET and MYND domain containing 1 | Transcription regulation, Repressor, DNA-binding, Nuclear protein, Zinc-finger, Metal-binding | 1002 | 4970 |
| Contig39933_RC | LOC90693 | Sequence 2 from Patent WO0220754. | Hypothetical protein | 1003 | 4971 |
| Contig39989_RC | MGC14289 | similar to RIKEN cDNA 1200014N16 gene | | 1004 | 4972 |
| Contig40015_RC | | Transcribed sequence with moderate similarity to protein pdb: 1LBG (*E. coli*) B Chain B, Lactose Operon Repressor Bound To 21-Base Pair Symmetric Operator Dna, Alpha Carbons Only | | 1005 | 4973 |
| Contig40026_RC | | CDNA FLJ12935 fis, clone NT2RP2004982 | | 1006 | 4974 |
| Contig40053_RC | HNRPD | heterogeneous nuclear ribonucleoprotein D (AU-rich element RNA binding protein 1, 37 kDa) | Nuclear protein, RNA-binding, DNA-binding, Ribonucleoprotein, Repeat, Transcription regulation, Telomere, Alternative splicing, 3D-structure | 1007 | 4975 |
| Contig40055_RC | | Transcribed sequences | | 1008 | 4976 |
| Contig40069_RC | | Transcribed sequences | | 1009 | 4977 |
| Contig40093_RC | | fatty acid binding protein 3, muscle and heart (mammary-derived growth inhibitor) | Transport, Lipid-binding, Acetylation, Phosphorylation, 3D-structure | 1010 | 4978 |
| Contig40094_RC | DKFZp434I099 | hypothetical protein DKFZp434I099 | Hypothetical protein | 1011 | 4979 |
| Contig40128_RC | | hypoxia-inducible factor 1, alpha subunit (basic helix-loop-helix transcription factor) | Transcription regulation, Activator, Nuclear protein, DNA-binding, Alternative splicing, Repeat, Acetylation, Hydroxylation, Phosphorylation, S-nitrosylation, Polymorphism, 3D-structure | 1012 | 4980 |
| Contig40184 | SLC2A1 | solute carrier family 2 (facilitated glucose transporter), member 1 | Transmembrane, Sugar transport, Transport, Glycoprotein, Multigene family, Disease mutation, 3D-structure | 1013 | 4981 |
| Contig40212_RC | CD5 | CD5 antigen (p56-62) | Signal, Transmembrane, Glycoprotein, T-cell, Repeat | 1014 | 4982 |
| Contig40237_RC | FLJ12525 | hypothetical protein FLJ12525 | Hypothetical protein | 1015 | 4983 |
| Contig40252_RC | | CDNA clone IMAGE: 3462401, partial cds | Hypothetical protein | 1016 | 4984 |
| Contig40340_RC | | hypothetical protein FLJ11000 | Hypothetical protein | 1017 | 4985 |
| Contig40389_RC | | Similar to RIKEN cDNA 3830422K02 (LOC387755), mRNA | | 1018 | 4986 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig404 | | Mesenchymal stem cell protein DSC96 mRNA, partial cds | | 1019 | 4987 |
| Contig40405_RC | MGC10818 | chromosome 6 open reading frame 148 | Hypothetical protein | 1020 | 4988 |
| Contig40410 | | tc14e12.x1 Soares_NhHMPu_S1 Homo sapiens cDNA clone IMAGE: 2063854 3', mRNA sequence. | Hypothetical protein | 1021 | 4989 |
| Contig40450_RC | | THAP domain containing 9 | Hypothetical protein | 1022 | 4990 |
| Contig40552_RC | FLJ25348 | hypothetical protein FLJ25348 | Hypothetical protein | 1023 | 4991 |
| Contig40651_RC | | Transcribed sequences | | 1024 | 4992 |
| Contig40676_RC | | Sequence 60 from Patent WO0220754. | | 1025 | 4993 |
| Contig40830_RC | TSGA14 | testis specific, 14 | Hypothetical protein | 1026 | 4994 |
| Contig40832_RC | | Transcribed sequences | | 1027 | 4995 |
| Contig40897_RC | DKFZP434J037 | likely ortholog of rat SNF1/AMP-activated protein kinase | Hypothetical protein, ATP-binding, Kinase, Serine/threonine-protein kinase, Transferase | 1028 | 4996 |
| Contig40960_RC | FLJ36991 | zinc finger protein 565 | Hypothetical protein, Metal-binding, Nuclear protein, Zinc, Zinc-finger | 1029 | 4997 |
| Contig40965_RC | MGC4504 | hypothetical protein MGC4504 | Hypothetical protein | 1030 | 4998 |
| Contig40967_RC | | LOC389388 (LOC389388), mRNA | | 1031 | 4999 |
| Contig41005_RC | | Transcribed sequence with strong similarity to protein pdb: 1BGM (*E. coli*) O Chain O, Beta-Galactosidase | | 1032 | 5000 |
| Contig41035 | | golgi phosphoprotein 4 | | 1033 | 5001 |
| Contig41041_RC | | CDNA FLJ32274 fis, clone PROST2000036 | | 1034 | 5002 |
| Contig41080_RC | | Transcribed sequences | | 1035 | 5003 |
| Contig41086_RC | | forkhead box P1 | Hypothetical protein, Transcription regulation, DNA-binding, Zinc-finger, Metal-binding, Nuclear protein, Alternative splicing | 1036 | 5004 |
| Contig41094_RC | EDG8 | endothelial differentiation, sphingolipid G-protein-coupled receptor, 8 | Hypothetical protein, Receptor | 1037 | 5005 |
| Contig41121_RC | FCRH3 | Fc receptor-like protein 3 | Immunoglobulin domain, Receptor | 1038 | 5006 |
| Contig41209_RC | FLJ21432 | adiponectin receptor 2 | Fatty acid metabolism, Lipid metabolism, Receptor, Transmembrane | 1039 | 5007 |
| Contig41226_RC | | MRNA; cDNA DKFZp434O232 (from clone DKFZp434O232) | Hypothetical protein | 1040 | 5008 |
| Contig412_RC | FLJ22233 | *Homo sapiens* cDNA FLJ36755 fis, clone UTERU2018180, weakly similar to Na+/Ca2+, K+-exchanging protein homolog C13D9.8. | Hypothetical protein | 1041 | 5009 |
| Contig41301 | LOC152217 | hypothetical protein BC007882 | Hypothetical protein | 1042 | 5010 |
| Contig41421_RC | FLJ36156 | piwi-like 2 (*Drosophila*) | Hypothetical protein | 1043 | 5011 |
| Contig41448_RC | | dynamin 1-like | | 1044 | 5012 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig41537 | MGC20496 | methylmalonic aciduria (cobalamin deficiency) type B | Transferase, Mitochondrion, Transit peptide, Polymorphism, Disease mutation | 1045 | 5013 |
| Contig41560_RC | CPT1A | carnitine palmitoyltransferase 1A (liver) | Transferase, Acyltransferase, Mitochondrion, Outer membrane, Fatty acid metabolism, Transport, Transmembrane, Multigene family | 1046 | 5014 |
| Contig41612_RC | | hypothetical protein LOC132241 | Hypothetical protein | 1047 | 5015 |
| Contig41618_RC | | Clone IMAGE: 5315196, mRNA | Hypothetical protein | 1048 | 5016 |
| Contig41638_RC | SLC26A8 | solute carrier family 26, member 8 | | 1049 | 5017 |
| Contig41656_RC | | Similar to Eph receptor A7, clone IMAGE: 5273054, mRNA | | 1050 | 5018 |
| Contig41701_RC | | Transcribed sequences | | 1051 | 5019 |
| Contig41748_RC | ELMO3 | engulfment and cell motility 3 (ced-12 homolog, *C. elegans*) | Apoptosis, Phagocytosis, Cytoskeleton, Membrane, SH3-binding | 1052 | 5020 |
| Contig41774_RC | | Transcribed sequences | | 1053 | 5021 |
| Contig41781_RC | ARHGEF7 | Rho guanine nucleotide exchange factor (GEF) 7 | Guanine-nucleotide releasing factor, SH3 domain, Alternative splicing, 3D-structure, Hypothetical protein | 1054 | 5022 |
| Contig41828_RC | | Clone IMAGE: 5310874, mRNA | | 1055 | 5023 |
| Contig41864_RC | ZFP106 | zinc finger protein 106 homolog (mouse) | Hypothetical protein, Metal-binding, Repeat, WD repeat, Zinc, Zinc-finger | 1056 | 5024 |
| Contig41869_RC | SFRS3 | splicing factor, arginine/serine-rich 3 | Nuclear protein, RNA-binding, mRNA splicing, Alternative splicing, Phosphorylation, Repeat | 1057 | 5025 |
| Contig41903_RC | FLJ21657 | hypothetical protein FLJ21657 | Hypothetical protein | 1058 | 5026 |
| Contig41923_RC | OATL1 | ornithine aminotransferase-like 1 | Transferase, Aminotransferase | 1059 | 5027 |
| Contig41936_RC | MSL3L1 | male-specific lethal 3-like 1 (*Drosophila*) | Chromatin regulator, Nuclear protein, Transcription regulation, Alternative splicing | 1060 | 5028 |
| Contig41983_RC | | ym35b12.s1 Soares infant brain 1NIB *Homo sapiens* cDNA clone IMAGE: 50144 3', mRNA sequence. | | 1061 | 5029 |
| Contig42005_RC | | splicing factor, arginine/serine-rich 11 | Nuclear protein, RNA-binding, mRNA splicing, Repeat | 1062 | 5030 |
| Contig42006_RC | | RasGEF domain family, member 1B | Hypothetical protein | 1063 | 5031 |
| Contig42012_RC | | zinc finger, DHHC domain containing 21 | Transmembrane, Zinc-finger | 1064 | 5032 |
| Contig42014_RC | RNTRE | USP6 N-terminal like | Hypothetical protein | 1065 | 5033 |
| Contig42076_RC | FLJ39091 | zinc binding alcohol dehydrogenase, domain containing 1 | Hypothetical protein | 1066 | 5034 |
| Contig42105_RC | | MRNA; cDNA DKFZp686P24244 (from clone DKFZp686P24244) | | 1067 | 5035 |
| Contig42146_RC | | chromosome 19 open reading frame 12 | Hypothetical protein | 1068 | 5036 |
| Contig42154_RC | FLJ11795 | hypothetical protein FLJ11795 | Hypothetical protein | 1069 | 5037 |
| Contig42174 | FLJ33215 | hypothetical protein FLJ33215 | Hypothetical protein | 1070 | 5038 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig42177_RC | | zinc finger, DHHC domain containing 19 | Hypothetical protein, Transmembrane, Zinc-finger | 1071 | 5039 |
| Contig42185_RC | TLR8 | toll-like receptor 8 | Hypothetical protein, Receptor, Immune response, Inflammatory response, Signal, Transmembrane, Repeat, Leucine-rich repeat, Glycoprotein | 1072 | 5040 |
| Contig421_RC | KIAA1821 | rab11-family interacting protein 4 | Hypothetical protein | 1073 | 5041 |
| Contig42256_RC | | Transcribed sequences | | 1074 | 5042 |
| Contig42263_RC | PSMB5 | ATP synthase, H+ transporting, mitochondrial F0 complex, subunit s (factor B) | Hydrogen ion transport, CF(0), Mitochondrion, Transit peptide, Hypothetical protein | 1075 | 5043 |
| Contig42270_RC | | similar to metallo-beta-lactamase superfamily protein | Hypothetical protein | 1076 | 5044 |
| Contig42330_RC | | Transcribed sequences | | 1077 | 5045 |
| Contig42342_RC | | CDNA FLJ39417 fis, clone PLACE6016942 | Hypothetical protein | 1078 | 5046 |
| Contig42418_RC | | Transcribed sequence with weak similarity to protein ref: NP_060265.1 (*H. sapiens*) hypothetical protein FLJ20378 [*Homo sapiens*] | | 1079 | 5047 |
| Contig42437_RC | C1orf28 | casein kinase 1, epsilon | Transferase, Serine/threonine-protein kinase, ATP-binding, Phosphorylation, Multigene family | 1080 | 5048 |
| Contig42459_RC | FLJ22021 | hypothetical protein FLJ22021 | Repeat, WD repeat | 1081 | 5049 |
| Contig42566_RC | FLJ14761 | hypothetical protein FLJ14761 | Hypothetical protein | 1082 | 5050 |
| Contig42591_RC | | shadow of prion protein | | 1083 | 5051 |
| Contig42593_RC | | Transcribed sequences | | 1084 | 5052 |
| Contig42597_RC | | wd88a09.x1 NCI_CGAP_Lu24 *Homo sapiens* cDNA clone IMAGE: 2338648 3', mRNA sequence. | | 1085 | 5053 |
| Contig42615_RC | AMID | apoptosis-inducing factor (AIF)-homologous mitochondrion-associated inducer of death | Hypothetical protein | 1086 | 5054 |
| Contig42617_RC | SNRPG | Human S6 H-8 mRNA expressed in chromosome 6-suppressed melanoma cells. | Ubiquitin conjugation, Hydrolase, Thiol protease, Multigene family, Alternative splicing | 1087 | 5055 |
| Contig42666_RC | | chromosome 10 open reading frame 47 | Hypothetical protein | 1088 | 5056 |
| Contig42759_RC | BCL11B | B-cell CLL/lymphoma 11B (zinc finger protein) | B-cell, Metal-binding, Zinc, Zinc-finger | 1089 | 5057 |
| Contig42787_RC | | hypothetical protein MGC5509 | Hypothetical protein | 1090 | 5058 |
| Contig42824_RC | FLJ10785 | ubiquitin specific protease 40 | Ubl conjugation pathway, Hydrolase, Thiol protease, Alternative splicing, Polymorphism, multigene family | 1091 | 5059 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig42854 | | CDNA FLJ33578 fis, clone BRAMY2011639 | | 1092 | 5060 |
| Contig42903_RC | | Transcribed sequence with strong similarity to protein ref: NP_002745.1 (*H. sapiens*) mitogen-activated protein kinase 13; mitogen-activated protein kinase p38 delta; stress-activated protein kianse 4 [*Homo sapiens*] | | 1093 | 5061 |
| Contig42959_RC | | solute carrier family 5 (sodium/glucose cotransporter), member 10 | Hypothetical protein | 1094 | 5062 |
| Contig42962_RC | | Transcribed sequence with weak similarity to protein pir: S41161 (*H. sapiens*) S41161 keratin 9, cytoskeletal - human | | 1095 | 5063 |
| Contig43022_RC | | similar to RIKEN cDNA 2610524G09 | | 1096 | 5064 |
| Contig43026_RC | | hypothetical protein DKFZp762C1112 | Hypothetical protein | 1097 | 5065 |
| Contig43096_RC | | Clone IMAGE: 5743799, mRNA | | 1098 | 5066 |
| Contig43169_RC | | DEAD (Asp-Glu-Ala-Asp) box polypeptide 51 | ATP-binding, Helicase, Hydrolase, Hypothetical protein | 1099 | 5067 |
| Contig43184_RC | | yg20d12.s1 Soares infant brain 1NIB *Homo sapiens* cDNA clone IMAGE: 32918 3', mRNA sequence. | | 1100 | 5068 |
| Contig43189_RC | | Transcribed sequences | | 1101 | 5069 |
| Contig43241_RC | ADCY7 | adenylate cyclase 7 | Lyase, cAMP biosynthesis, Transmembrane, Glycoprotein, Repeat, Metal-binding, Magnesium | 1102 | 5070 |
| Contig43253_RC | KIAA1858 | zinc finger protein 469 | Transcription regulation, DNA-binding, Zinc-finger, Metal-binding, Nuclear protein, Repeat | 1103 | 5071 |
| Contig43262_RC | | Transcribed sequences | | 1104 | 5072 |
| Contig43277_RC | | Similar to KIAA1726 protein (LOC340554), mRNA | | 1105 | 5073 |
| Contig43289_RC | | hypothetical protein LOC170371 | | 1106 | 5074 |
| Contig43385_RC | DKFZp762O076 | hypothetical protein DKFZp762O076 | Hypothetical protein | 1107 | 5075 |
| Contig43436_RC | FLJ32028 | hypothetical protein FLJ32028 | Hypothetical protein | 1108 | 5076 |
| Contig43486_RC | DRB1 | developmentally regulated RNA-binding protein 1 | Hypothetical protein | 1109 | 5077 |
| Contig43506_RC | | GLI pathogenesis-related 1 (glioma) | | 1110 | 5078 |
| Contig43513_RC | TIGD7 | *Homo sapiens* cDNA FLJ13533 fis, clone PLACE1006371. | | 1111 | 5079 |
| Contig43534 | | ankyrin repeat domain 10 | Hypothetical protein, ANK repeat, Repeat | 1112 | 5080 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig43540_RC | GRIM19 | FLJ44968 protein | Oxidoreductase, Ubiquinone, NAD, Apoptosis, Mitochondrion, Transmembrane, Acetylation, Hypothetical protein | 1113 | 5081 |
| Contig43542_RC | | KIAA1718 protein | Hypothetical protein | 1114 | 5082 |
| Contig43549_RC | SNX5 | Homo sapiens, clone MGC: 3411 IMAGE: 3629947, mRNA, complete cds. | Hypothetical protein, Transport, Protein transport | 1115 | 5083 |
| Contig43586_RC | | hypothetical protein LOC134218 | | 1116 | 5084 |
| Contig43645_RC | | hypothetical protein LOC129607 | Hypothetical protein | 1117 | 5085 |
| Contig43655_RC | NAG14 | leucine rich repeat containing 4 | Immunoglobulin domain, Hypothetical protein, Signal | 1118 | 5086 |
| Contig43658_RC | | likely ortholog of mouse cancer related gene - liver 2 | | 1119 | 5087 |
| Contig4365_RC | TGOLN2 | trans-golgi network protein 2 | Hypothetical protein, Signal, Transmembrane, Glycoprotein, Repeat, Golgi stack, Alternative splicing | 1120 | 5088 |
| Contig43673_RC | FLJ20481 | calpain small subunit 2 | Hypothetical protein | 1121 | 5089 |
| Contig43679_RC | MEF-2 | myelin expression factor 2 | Hypothetical protein | 1122 | 5090 |
| Contig43694_RC | TSPAN-2 | tetraspan 2 | Glycoprotein, Transmembrane | 1123 | 5091 |
| Contig43703_RC | CDH13 | CDNA FLJ25967 fis, clone CBR01929 | Cell adhesion, Glycoprotein, Calcium-binding, Repeat, GPI-anchor, Signal | 1124 | 5092 |
| Contig43724_RC | FLJ13213 | hypothetical protein FLJ13213 | Hypothetical protein | 1125 | 5093 |
| Contig43746_RC | | CDNA FLJ41107 fis, clone BLADE2007923 | | 1126 | 5094 |
| Contig43749_RC | MGC14258 | Rho GTPase activating protein 19 | Hypothetical protein | 1127 | 5095 |
| Contig43750_RC | | cleavage and polyadenylation specific factor 6, 68 kDa | | 1128 | 5096 |
| Contig43817_RC | RINZF | zinc finger and BTB domain containing 10 | Hypothetical protein, Metal-binding, Zinc, Zinc-finger | 1129 | 5097 |
| Contig438_RC | | hypothetical protein MGC61716 | EGF-like domain, Hypothetical protein | 1130 | 5098 |
| Contig4399_RC | MYH9 | myosin, heavy polypeptide 9, non-muscle | Myosin, ATP-binding, Calmodulin-binding, Actin-binding, Coiled coil, Multigene family, Disease mutation, Deafness, Hypothetical protein | 1131 | 5099 |
| Contig440 | MGC3165 | Homo sapiens, H2A histone family, member L, clone MGC: 3165 IMAGE: 3355200, mRNA, complete cds. | Acetylation, Chromosomal protein, DNA-binding, Multigene family, Nuclear protein, Nucleosome core | 1132 | 5100 |
| Contig44059_RC | | hypothetical protein DKFZp564B1162 | Hypothetical protein | 1133 | 5101 |
| Contig44078 | TA-WDRP | T-cell activation WD repeat protein | Hypothetical protein, Repeat, WD repeat | 1134 | 5102 |
| Contig44105 | OSBPL11 | oxysterol binding protein-like 11 | Hypothetical protein, Lipid transport, Transport | 1135 | 5103 |
| Contig44124_RC | | CDNA FLJ30906 fis, clone FEBRA2006055 | Hypothetical protein | 1136 | 5104 |
| Contig44133_RC | FLJ11362 | hypothetical protein FLJ11362 | Hypothetical protein, ANK repeat, Repeat | 1137 | 5105 |
| Contig44192_RC | | Cas-Br-M (murine) ecotropic retroviral transforming sequence | Hypothetical protein, Ligase, Ubl conjugation pathway, Proto-oncogene, Zinc-finger, SH2 domain, Phosphorylation, Calcium-binding, 3D-structure | 1138 | 5106 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig44226_RC | TIGD2 | tigger transposable element derived 2 | | 1139 | 5107 |
| Contig44265_RC | | ATPase, aminophospholipid transporter (APLT), Class I, type 8A, member 1 | Hydrolase, Transmembrane, Phosphorylation, Magnesium, ATP-binding, Alternative splicing, Multigene family | 1140 | 5108 |
| Contig44278_RC | DKFZp434K114 | WD repeat domain 21 | Repeat, WD repeat, Hypothetical protein, Plasmid | 1141 | 5109 |
| Contig44343 | | CDNA FLJ26676 fis, clone MPG03726 | | 1142 | 5110 |
| Contig44358_RC | DKFZp434N035 | Hypothetical LOC284874 (LOC284874), mRNA | Hypothetical protein | 1143 | 5111 |
| Contig44409 | | similar to LL5 beta | Hypothetical protein | 1144 | 5112 |
| Contig44414_RC | SLC30A1 | solute carrier family 30 (zinc transporter), member 1 | Zinc transport, Transport, Transmembrane, Multigene family | 1145 | 5113 |
| Contig44492_RC | | Transcribed sequences | | 1146 | 5114 |
| Contig44518_RC | FAM11A | family with sequence similarity 11, member A | Antigen, Multigene family, Tumor antigen, Hypothetical protein | 1147 | 5115 |
| Contig44521_RC | | LSM8 homolog, U6 small nuclear RNA associated (*S. cerevisiae*) | Nuclear protein, Ribonucleoprotein, mRNA splicing, mRNA processing, RNA-binding, Acetylation | 1148 | 5116 |
| Contig44548_RC | | hypothetical protein LOC283508 | | 1149 | 5117 |
| Contig44593_RC | | retinoblastoma binding protein 6 | Hypothetical protein, Metal-binding, Zinc, Zinc-finger | 1150 | 5118 |
| Contig44595_RC | | hypothetical protein MGC45840 | Hypothetical protein | 1151 | 5119 |
| Contig44596_RC | PPIL3 | peptidylprolyl isomerase (cyclophilin)-like 3 | Isomerase, Rotamase, Hypothetical protein | 1152 | 5120 |
| Contig44708_RC | BCAT1 | *Homo sapiens* cDNA: FLJ21270 fis, clone COL01749. | Hypothetical protein, Transferase, Aminotransferase, Branched-chain amino acid biosynthesis, Pyridoxal phosphate | 1153 | 5121 |
| Contig44713 | | transducin-like enhancer of split 4 (E(sp1) homolog, *Drosophila*) | Transcription regulation, Repressor, Nuclear protein, Repeat, WD repeat, Phosphorylation, Wnt signaling pathway | 1154 | 5122 |
| Contig44720_RC | FKSG32 | hypothetical protein FKSG32 | Hypothetical protein | 1155 | 5123 |
| Contig44723_RC | | Human cAMP-binding guanine nucleotide exchange factor IV (cAMP-GEFIV) mRNA, clone W15, partial sequence | | 1156 | 5124 |
| Contig44757_RC | VIM | Transcribed sequence with strong similarity to protein pir: A25074 (*H. sapiens*) A25074 vimentin - human | Hypothetical protein, Coiled coil, Intermediate filament, Phosphorylation, 3D-structure | 1157 | 5125 |
| Contig44817_RC | C20orf147 | chromosome 20 open reading frame 147 | Hydrolase | 1158 | 5126 |
| Contig44874_RC | LOC57805 | p30 DBC protein | Hypothetical protein | 1159 | 5127 |
| Contig44877_RC | KIAA1877 | beta-galactoside alpha-2,6-sialyltransferase II | Hypothetical protein, Transferase, Glycosyltransferase | 1160 | 5128 |
| Contig44964_RC | | hypothetical gene supported by BC017510; BC046919 | | 1161 | 5129 |
| Contig45004_RC | | hypothetical protein LOC283129 | | 1162 | 5130 |
| Contig45080_RC | CUL5 | cullin 5 | Ubl conjugation pathway, Ubl conjugation, Receptor | 1163 | 5131 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig45085_RC | ATP6V0A2 | Homo sapiens cDNA FLJ32238 fis, clone PLACE6004993. | Hydrogen ion transport, Transmembrane, Glycoprotein, Hypothetical protein | 1164 | 5132 |
| Contig45135 | | CDNA: FLJ22382 fis, clone HRC07514 | | 1165 | 5133 |
| Contig45201_RC | C1QTNF2 | C1q and tumor necrosis factor related protein 2 | Collagen, Signal | 1166 | 5134 |
| Contig45290_RC | | Similar to RIKEN cDNA 3010021M21 (LOC388185), mRNA | | 1167 | 5135 |
| Contig45304_RC | DEPC-1 | prostate cancer antigen-1 | | 1168 | 5136 |
| Contig45305_RC | MGC3130 | hypothetical protein MGC3130 | Hypothetical protein | 1169 | 5137 |
| Contig45328_RC | | Similar to Ab2-183 (LOC158830), mRNA | | 1170 | 5138 |
| Contig45338_RC | CSNK2A1 | casein kinase 2, alpha 1 polypeptide | Transferase, Serine/threonine-protein kinase, ATP-binding, Wnt signaling pathway, 3D-structure | 1171 | 5139 |
| Contig45377_RC | C10orf2 | progressive external ophthalmoplegia 1 | Hypothetical protein, Helicase | 1172 | 5140 |
| Contig45381_RC | | hypothetical protein LOC283663 | | 1173 | 5141 |
| Contig45396_RC | FLJ13197 | hypothetical protein FLJ13197 | Hypothetical protein | 1174 | 5142 |
| Contig45397_RC | FLJ34299 | zinc finger protein 92 (HTF12) | Hypothetical protein, Metal-binding, Nuclear protein, Zinc, Zinc-finger, Transcription regulation, DNA-binding, Repeat | 1175 | 5143 |
| Contig45437 | | similar to RNA polymerase B transcription factor 3 | Hypothetical protein | 1176 | 5144 |
| Contig45440_RC | | Similar to RIKEN cDNA 9330196J05 (LOC340075), mRNA | | 1177 | 5145 |
| Contig45455_RC | | soluble liver antigen/liver pancreas antigen | | 1178 | 5146 |
| Contig45457_RC | CYP4F12 | cytochrome P450, family 4, subfamily F, polypeptide 12 | Oxidoreductase, Monooxygenase, Electron transport, Membrane, Heme, Microsome, Endoplasmic reticulum, Polymorphism | 1179 | 5147 |
| Contig45540_RC | | G protein-coupled receptor 114 | Receptor | 1180 | 5148 |
| Contig45544_RC | | protein kinase, interferon-inducible double stranded RNA dependent activator | Hypothetical protein, Kinase | 1181 | 5149 |
| Contig45569_RC | CDC14B | CDC14 cell division cycle 14 homolog B (S. cerevisiae) | Hydrolase | 1182 | 5150 |
| Contig45624_RC | HAKAI | Cas-Br-M (murine) ecotropic retroviral transforming sequence-like 1 | Hypothetical protein, Metal-binding, Zinc, Zinc-finger | 1183 | 5151 |
| Contig45634_RC | | Similar to FLJ46354 protein (LOC389694), mRNA | Hypothetical protein | 1184 | 5152 |
| Contig45642_RC | | mitogen-activated protein kinase kinase kinase 2 | ATP-binding, Kinase, Transferase, Serine/threonine-protein kinase, Hypothetical protein | 1185 | 5153 |
| Contig45790_RC | KIAA0187 | ESTs, Moderately similar to KIAA0187 gene product [Homo sapiens] [H. sapiens] | | 1186 | 5154 |
| Contig45800_RC | MTX1 | metaxin 1 | Mitochondrion, Outer membrane, Transmembrane, Transport, Protein transport | 1187 | 5155 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig45816_RC | MGC4832 | chromosome 13 open reading frame 3 | Hypothetical protein | 1188 | 5156 |
| Contig45821_RC | ADCY4 | adenylate cyclase 4 | Hypothetical protein, Lyase, cAMP biosynthesis, Transmembrane, Glycoprotein, Repeat, Metal-binding, Magnesium | 1189 | 5157 |
| Contig45847_RC | DKFZP761I2123 | hypothetical protein DKFZp761I2123 | Hypothetical protein | 1190 | 5158 |
| Contig45879_RC | KIAA1145 | KIAA1145 protein | Hypothetical protein, Transmembrane | 1191 | 5159 |
| Contig45891_RC | | CDNA FLJ37509 fis, clone BRCAN1000065 | | 1192 | 5160 |
| Contig45944_RC | ZNF335 | zinc finger protein 335 | Transcription regulation, Zinc-finger, Metal-binding, Nuclear protein, DNA-binding, Repeat | 1193 | 5161 |
| Contig45945_RC | | Transcribed sequences | | 1194 | 5162 |
| Contig4595 | | hypothetical LOC387763 | Hypothetical protein | 1195 | 5163 |
| Contig45975_RC | | Transcribed sequences | | 1196 | 5164 |
| Contig45984 | USP7 | ubiquitin specific protease 7 (herpes virus-associated) | Ubl conjugation pathway, Hydrolase, Thiol protease, Multigene family, Nuclear protein, 3D-structure | 1197 | 5165 |
| Contig46052_RC | | ectonucleoside triphosphate diphosphohydrolase 1 | Hydrolase, Transmembrane, Antigen, Glycoprotein, Calcium, Magnesium, Alternative splicing, Lipoprotein, Palmitate | 1198 | 5166 |
| Contig46178_RC | | *Homo sapiens*, clone IMAGE: 5276307, mRNA. | | 1199 | 5167 |
| Contig461_RC | KIAA1836 | KIAA1836 protein | Hypothetical protein | 1200 | 5168 |
| Contig46202 | MAD | MAX dimerization protein 1 | Nuclear protein, DNA-binding, Transcription regulation, Repressor, 3D-structure | 1201 | 5169 |
| Contig46218_RC | | Similar to diaphanous homolog 3 (*Drosophila*), clone IMAGE: 5277415, mRNA | | 1202 | 5170 |
| Contig46244_RC | | Clone IMAGE: 111705 mRNA sequence | | 1203 | 5171 |
| Contig46262_RC | | Similar to 2010300C02Rik protein (LOC343990), mRNA | | 1204 | 5172 |
| Contig46265_RC | | LOH11CR1J gene, loss of heterozygosity, 11, chromosomal region 1 gene J product | | 1205 | 5173 |
| Contig46294_RC | | Transcribed sequence with weak similarity to protein ref: NP_060312.1 (*H. sapiens*) hypothetical protein FLJ20489 [*Homo sapiens*] | | 1206 | 5174 |
| Contig46306_RC | | CDNA FLJ36097 fis, clone TESTI2020956 | | 1207 | 5175 |
| Contig46343_RC | SPP1 | suppressor of cytokine signaling 7 | SH2 domain, Growth regulation, Signal transduction inhibitor | 1208 | 5176 |
| Contig46375_RC | | CDNA FLJ26349 fis, clone HRT04618 | | 1209 | 5177 |
| Contig46376_RC | | zinc finger and BTB domain containing 10 | Hypothetical protein, Metal-binding, Zinc, Zinc-finger | 1210 | 5178 |
| Contig46399_RC | | Transcribed sequences | | 1211 | 5179 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig46416_RC | MGC33212 | hypothetical protein MGC33212 | | 1212 | 5180 |
| Contig46421_RC | | Transcribed sequence with moderate similarity to protein ref: NP_005496.1 (*H. sapiens*) CD36 antigen | | 1213 | 5181 |
| Contig46437_RC | | synaptotagmin binding, cytoplasmic RNA interacting protein | Transport, Protein transport | 1214 | 5182 |
| Contig46443_RC | | solute carrier family 26, member 11 | Hypothetical protein | 1215 | 5183 |
| Contig46464_RC | | Transcribed sequences | | 1216 | 5184 |
| Contig46482_RC | | MRNA; cDNA DKFZp434C1435 (from clone DKFZp434C1435) | | 1217 | 5185 |
| Contig46506_RC | | MRNA; cDNA DKFZp686C18110 (from clone DKFZp686C18110) | | 1218 | 5186 |
| Contig46536_RC | LGI3 | leucine-rich repeat LGI family, member 3 | Repeat, Leucine-rich repeat, Signal, Hypothetical protein | 1219 | 5187 |
| Contig46563_RC | | Transcribed sequences | | 1220 | 5188 |
| Contig46567 | | Transcribed sequences | | 1221 | 5189 |
| Contig46586 | UBE2D3 | ubiquitin-conjugating enzyme E2D 3 (UBC4/5 homolog, yeast) | Hypothetical protein, Ligase, Ubl conjugation pathway, Multigene family | 1222 | 5190 |
| Contig46590 | RAD50 | CDNA FLJ46914 fis, clone SPLEN2027852 | Hypothetical protein | 1223 | 5191 |
| Contig46591_RC | | hypothetical protein LOC90639 | | 1224 | 5192 |
| Contig46601_RC | | CDNA FLJ42198 fis, clone THYMU2034338 | | 1225 | 5193 |
| Contig46602_RC | | zinc finger, CCHC domain containing 6 | Hypothetical protein | 1226 | 5194 |
| Contig46634 | | Transcribed sequences | | 1227 | 5195 |
| Contig46700_RC | LSP1 | small proline rich protein 4 | Phosphorylation, T-cell | 1228 | 5196 |
| Contig46709_RC | FLJ23045 | chromosome 20 open reading frame 23 | Transport, Protein transport, Hypothetical protein | 1229 | 5197 |
| Contig46732_RC | | zinc finger protein 207 | Hypothetical protein, Zinc-finger, Metal-binding, DNA-binding, Nuclear protein, Alternative splicing | 1230 | 5198 |
| Contig46747_RC | | parvin, gamma | Cell adhesion, Cytoskeleton, Actin-binding, Repeat, Alternative splicing | 1231 | 5199 |
| Contig46860_RC | | FLJ20758 protein | Hypothetical protein | 1232 | 5200 |
| Contig46881_RC | | Transcribed sequences | | 1233 | 5201 |
| Contig46954_RC | PNMA3 | paraneoplastic antigen MA3 | Hypothetical protein | 1234 | 5202 |
| Contig46999_RC | | CDNA FLJ26950 fis, clone RCT08544 | | 1235 | 5203 |
| Contig47014_RC | MGC24180 | hypothetical protein MGC24180 | Hypothetical protein | 1236 | 5204 |
| Contig47015_RC | | hypothetical protein FLJ21439 | Hypothetical protein | 1237 | 5205 |
| Contig47025_RC | | Hypothetical gene supported by AK094796 (LOC400764), mRNA | | 1238 | 5206 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig47042 | FLJ20069 | Abelson helper integration site | Hypothetical protein, Repeat, SH3 domain, WD repeat | 1239 | 5207 |
| Contig47081_RC | | LOC392751 (LOC392751), mRNA | | 1240 | 5208 |
| Contig47096_RC | PFKFB4 | 6-phosphofructo-2-kinase/fructose-2,6-biphosphatase 4 | Multifunctional enzyme, Transferase, Kinase, Hydrolase, ATP-binding, Phosphorylation, Multigene family, 3D-structure | 1241 | 5209 |
| Contig47184_RC | | LOC400813 (LOC400813), mRNA | | 1242 | 5210 |
| Contig47203_RC | | sortilin-related receptor, L(DLR class) A repeats-containing | Endocytosis, Receptor, Transmembrane, EGF-like domain, Repeat, Glycoprotein, LDL, Lipid transport, Cholesterol metabolism, Signal | 1243 | 5211 |
| Contig47221_RC | VCP | valosin-containing protein | ATP-binding, Transport, Phosphorylation, Repeat, Golgi stack, Endoplasmic reticulum, Hypothetical protein | 1244 | 5212 |
| Contig47368_RC | LOC92691 | hypothetical protein BC008604 | Hypothetical protein | 1245 | 5213 |
| Contig47441_RC | | ubiquitin-conjugating enzyme E2 variant 2 | Ligase, Ubl conjugation pathway, Vitamin D | 1246 | 5214 |
| Contig47464_RC | ZNF335 | zinc finger protein 335 | Transcription regulation, Zinc-finger, Metal-binding, Nuclear protein, DNA-binding, Repeat | 1247 | 5215 |
| Contig47495_RC | IDI2 | GTP binding protein 4 | GTP-binding, Nuclear protein | 1248 | 5216 |
| Contig47498_RC | TMPRSS5 | transmembrane protease, serine 5 (spinesin) | Hydrolase, Serine protease, Transmembrane, Signal-anchor, Glycoprotein | 1249 | 5217 |
| Contig47539_RC | | SGT1, suppressor of G2 allele of SKP1 (*S. cerevisiae*) | Ubl conjugation pathway, Repeat, TPR repeat | 1250 | 5218 |
| Contig47582_RC | FLJ22757 | family with sequence similarity 31, member C | Hypothetical protein | 1251 | 5219 |
| Contig47732_RC | EPS8R3 | EPS8-like 3 | SH3 domain, Hypothetical protein, Receptor | 1252 | 5220 |
| Contig47770_RC | LY6G6C | lymphocyte antigen 6 complex, locus G6C | Signal | 1253 | 5221 |
| Contig47793_RC | FLJ23311 | FLJ23311 protein | Hypothetical protein | 1254 | 5222 |
| Contig47801_RC | | CDNA FLJ45814 fis, clone NT2RP7018126 | | 1255 | 5223 |
| Contig47810_RC | IMMP2L | IMP2 inner mitochondrial membrane protease-like (*S. cerevisiae*) | Coated pits | 1256 | 5224 |
| Contig47814_RC | HHGP | phosphoribosyl transferase domain containing 1 | Transferase | 1257 | 5225 |
| Contig47835_RC | | similar to RIKEN cDNA 2600017H02 | Hypothetical protein | 1258 | 5226 |
| Contig47863_RC | FLJ11939 | latrophilin 1 | Hypothetical protein, Receptor, Transmembrane | 1259 | 5227 |
| Contig47889_RC | COPS7B | COP9 constitutive photomorphogenic homolog subunit 7B (*Arabidopsis*) | Hypothetical protein | 1260 | 5228 |
| Contig47900_RC | FLJ12604 | hypothetical protein FLJ12604 | Hypothetical protein | 1261 | 5229 |
| Contig47912_RC | NR1D2 | nuclear receptor subfamily 1, group D, member 2 | Hypothetical protein, Receptor, Transcription regulation, DNA-binding, Nuclear protein, Zinc-finger, Repressor | 1262 | 5230 |
| Contig47922_RC | BRAP | BRCA1 associated protein | Metal-binding, Zinc, Zinc-finger | 1263 | 5231 |
| Contig47926_RC | FLJ13057 | germ cell-less homolog 1 (*Drosophila*) | Hypothetical protein | 1264 | 5232 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig47942_RC | LOC91893 | hypothetical protein BC006136 | Hypothetical protein | 1265 | 5233 |
| Contig47975_RC | | CDNA clone IMAGE: 5757380, partial cds | | 1266 | 5234 |
| Contig47982_RC | | hypothetical protein LOC112868 | | 1267 | 5235 |
| Contig48059 | FLJ12788 | hypothetical protein FLJ12788 | Hypothetical protein | 1268 | 5236 |
| Contig48144_RC | FLJ11152 | chromosome 6 open reading frame 70 | Hypothetical protein | 1269 | 5237 |
| Contig48156_RC | | proprotein convertase subtilisin/kexin type 9 | Cholesterol metabolism, Lipid metabolism, Hydrolase, Protease, Serine protease, Calcium, Signal, Autocatalytic cleavage, Zymogen, Glycoprotein, Alternative splicing, Polymorphism, Disease mutation | 1270 | 5238 |
| Contig48168_RC | LOC113246 | CDNA FLJ46484 fis, clone THYMU3026350 | Hypothetical protein | 1271 | 5239 |
| Contig48215_RC | FLJ35801 | hypothetical protein FLJ35801 | Hypothetical protein | 1272 | 5240 |
| Contig48249_RC | FLJ10849 | hypothetical protein FLJ10849 | Hypothetical protein | 1273 | 5241 |
| Contig48270_RC | LOC144097 | hypothetical protein BC007540 | Hypothetical protein | 1274 | 5242 |
| Contig48277_RC | FLJ36175 | hypothetical protein FLJ36175 | Repeat, WD repeat, Hypothetical protein | 1275 | 5243 |
| Contig48290_RC | MN7 | CDNA FLJ43285 fis, clone MESAN2000067 | Hypothetical protein | 1276 | 5244 |
| Contig48355_RC | | methionine aminopeptidase 1D | | 1277 | 5245 |
| Contig48371 | | malate dehydrogenase 1, NAD (soluble) | Oxidoreductase, Tricarboxylic acid cycle, NAD | 1278 | 5246 |
| Contig48406_RC | | chromosome 12 open reading frame 6 | Hypothetical protein | 1279 | 5247 |
| Contig48466_RC | FLJ12649 | hypothetical protein FLJ12649 | Hypothetical protein | 1280 | 5248 |
| Contig48472_RC | MAD3 | MAX dimerization protein 3 | Hypothetical protein | 1281 | 5249 |
| Contig48480_RC | | ring finger protein 24 | Zinc-finger | 1282 | 5250 |
| Contig48489_RC | | similar to K06A9.1b.p | Hypothetical protein | 1283 | 5251 |
| Contig48506_RC | KIAA1799 | KIAA1799 protein | Hypothetical protein | 1284 | 5252 |
| Contig48529_RC | CKLFSF2 | chemokine-like factor super family 2 | Chemotaxis, Cytokine, Transmembrane | 1285 | 5253 |
| Contig48588_RC | KIAA1706 | KIAA1706 protein | Hypothetical protein | 1286 | 5254 |
| Contig48697_RC | PFKFB2 | 6-phosphofructo-2-kinase/fructose-2,6-biphosphatase 2 | Multifunctional enzyme, Transferase, Kinase, Hydrolase, ATP-binding, Phosphorylation, Alternative splicing, Multigene family | 1287 | 5255 |
| Contig48722_RC | | Clone IMAGE: 5729395, mRNA | | 1288 | 5256 |
| Contig48764_RC | | CDNA clone MGC: 71984 IMAGE: 4280819, complete cds | Hypothetical protein | 1289 | 5257 |
| Contig48806_RC | | Similar to RIKEN cDNA E130012A19 (LOC390789), mRNA | | 1290 | 5258 |
| Contig48830_RC | RPL13 | ribosomal protein L13 | Ribosomal protein | 1291 | 5259 |
| Contig48834_RC | YR-29 | KIAA0888 protein | Nuclear protein | 1292 | 5260 |
| Contig48914_RC | | hypothetical protein MGC24133 | Hypothetical protein | 1293 | 5261 |
| Contig48944_RC | | Transcribed sequences | | 1294 | 5262 |
| Contig48951_RC | | chromosome 9 open reading frame 85 | Hypothetical protein | 1295 | 5263 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig48983_RC | | CDNA FLJ14294 fis, clone PLACE1008181 | | 1296 | 5264 |
| Contig48988_RC | LOC51099 | abhydrolase domain containing 5 | Hypothetical protein | 1297 | 5265 |
| Contig49000_RC | | CDNA FLJ30257 fis, clone BRACE2002467 | | 1298 | 5266 |
| Contig49012_RC | | hypothetical protein DKFZp434J0617 | Hypothetical protein | 1299 | 5267 |
| Contig49063_RC | A1BG | alpha-1-B glycoprotein | Hypothetical protein, Immunoglobulin domain, Glycoprotein, Plasma, Repeat, Signal | 1300 | 5268 |
| Contig49169_RC | SUV39H2 | suppressor of variegation 3-9 homolog 2 (*Drosophila*) | Hypothetical protein, Transferase, Methyltransferase, Chromatin regulator, Nuclear protein, Alternative splicing | 1301 | 5269 |
| Contig49185_RC | MGC2744 | hypothetical protein MGC2744 | Hypothetical protein | 1302 | 5270 |
| Contig49233_RC | NRBF-2 | nuclear receptor binding factor 2 | Receptor, Hypothetical protein | 1303 | 5271 |
| Contig49254_RC | RAD53 | *Homo sapiens*, clone MGC: 2637 IMAGE: 3505128, mRNA, complete cds. | Hypothetical protein, ATP-binding, Kinase, Serine/threonine-protein kinase, Transferase, Cell cycle, Phosphorylation, Nuclear protein, Disease mutation, Li-Fraumeni syndrome, 3D-structure | 1304 | 5272 |
| Contig49255_RC | | leucine-rich PPR-motif containing | Hypothetical protein, Repeat | 1305 | 5273 |
| Contig49279_RC | | hypothetical protein FLJ25461 | Hypothetical protein | 1306 | 5274 |
| Contig49306_RC | DKFZP586K0717 | ligand of numb-protein X | Zinc-finger, Repeat, Alternative splicing | 1307 | 5275 |
| Contig49344 | FLJ22474 | growth hormone regulated TBC protein 1 | Hypothetical protein | 1308 | 5276 |
| Contig49353_RC | MGC41917 | zinc finger protein 550 | Hypothetical protein, Metal-binding, Nuclear protein, Zinc, Zinc-finger | 1309 | 5277 |
| Contig49409 | | ty82g05.x1 NCI_CGAP_Kid11 *Homo sapiens* cDNA clone IMAGE: 2285624 3', mRNA sequence. | | 1310 | 5278 |
| Contig49468_RC | | MRNA; cDNA DKFZp667N1113 (from clone DKFZp667N1113) | | 1311 | 5279 |
| Contig49509_RC | KIAA1673 | cytoplasmic polyadenylation element binding protein 4 | Hypothetical protein | 1312 | 5280 |
| Contig49522_RC | | hypothetical protein FLJ13105 | Hypothetical protein | 1313 | 5281 |
| Contig49578_RC | FLJ20274 | xj92d05.x1 Soares_NFL_T_GBC_S1 *Homo sapiens* cDNA clone IMAGE: 2664681 3', mRNA sequence. | Hypothetical protein | 1314 | 5282 |
| Contig49591_RC | | activating transcription factor 7 interacting protein 2 | Hypothetical protein | 1315 | 5283 |
| Contig49631_RC | ATP11C | ATPase, Class VI, type 11C | Hydrolase, Transmembrane, Phosphorylation, Magnesium, Metal-binding, ATP-binding, Multigene family, Alternative splicing | 1316 | 5284 |
| Contig49667_RC | | deaminase domain containing 1 | | 1317 | 5285 |
| Contig49673_RC | AD034 | RIO kinase 1 (yeast) | Kinase, Hypothetical protein | 1318 | 5286 |
| Contig49725_RC | LOC51611 | CDNA clone IMAGE: 4821863, partial cds | Transferase, Methyltransferase, Alternative splicing, Hypothetical protein | 1319 | 5287 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig49738_RC | ATIC | aj25f09.s1 Soares_testis_NHT *Homo sapiens* cDNA clone 1391369 3', mRNA sequence. | Purine biosynthesis, Transferase, Hydrolase, Multifunctional enzyme | 1320 | 5288 |
| Contig49744_RC | FLJ14166 | hypothetical protein FLJ14166 | Hypothetical protein | 1321 | 5289 |
| Contig49756_RC | | Transcribed sequences | | 1322 | 5290 |
| Contig49849_RC | C6orf1 | hypothetical protein MGC57858 | Hypothetical protein | 1323 | 5291 |
| Contig49855 | MGC33338 | hypothetical protein MGC33338 | Hypothetical protein | 1324 | 5292 |
| Contig49875 | | Full length insert cDNA YN61C04 | | 1325 | 5293 |
| Contig49948_RC | MGC27385 | potassium channel tetramerisation domain containing 6 | Hypothetical protein | 1326 | 5294 |
| Contig49966_RC | | CDNA FLJ31683 fis, clone NT2RI2005353 | | 1327 | 5295 |
| Contig49983_RC | MGC3121 | hypothetical protein MGC3121 | Hypothetical protein | 1328 | 5296 |
| Contig49991_RC | | Transcribed sequence with weak similarity to protein ref: NP_062553.1 (*H. sapiens*) hypothetical protein FLJ11267 [*Homo sapiens*] | | 1329 | 5297 |
| Contig50039_RC | KIAA0140 | similar to CG9643-PA | Hypothetical protein | 1330 | 5298 |
| Contig50106_RC | KIAA1708 | kinesin family member 21A | Hypothetical protein | 1331 | 5299 |
| Contig50117_RC | | Transcribed sequences | | 1332 | 5300 |
| Contig50134_RC | BITE | p10-binding protein | Hypothetical protein | 1333 | 5301 |
| Contig50137_RC | MGC12992 | hypothetical protein MGC12992 | GTP-binding, Microtubules, Multigene family | 1334 | 5302 |
| Contig50177_RC | MBLR | ring finger protein 134 | Hypothetical protein, Metal-binding, Zinc, Zinc-finger | 1335 | 5303 |
| Contig50190_RC | LOC51005 | MRNA; cDNA DKFZp313E2215 (from clone DKFZp313E2215) | Glycoprotein, Ion transport, Ionic channel, Transmembrane | 1336 | 5304 |
| Contig50194_RC | C9orf16 | chromosome 9 open reading frame 16 | Hypothetical protein, Coiled coil | 1337 | 5305 |
| Contig50211_RC | MGC35392 | hypothetical protein MGC35392 | Hypothetical protein | 1338 | 5306 |
| Contig50220_RC | FLJ13231 | hypothetical protein FLJ13231 | Hypothetical protein | 1339 | 5307 |
| Contig50232_RC | DDX31 | DEAD (Asp-Glu-Ala-Asp) box polypeptide 31 | ATP-binding, Helicase, Hydrolase, Hypothetical protein | 1340 | 5308 |
| Contig50249_RC | MGC23908 | similar to RNA polymerase B transcription factor 3 | Hypothetical protein | 1341 | 5309 |
| Contig50272_RC | | Transcribed sequences | | 1342 | 5310 |
| Contig50273_RC | | hypothetical protein LOC255783 | Hypothetical protein | 1343 | 5311 |
| Contig50275_RC | gm117 | gm117 | | 1344 | 5312 |
| Contig50293_RC | EGFR-RS | rhomboid family 1 (*Drosophila*) | Hypothetical protein, Receptor | 1345 | 5313 |
| Contig50295_RC | FLJ12541 | stimulated by retinoic acid gene 6 | Hypothetical protein | 1346 | 5314 |
| Contig50298_RC | FLJ32370 | hypothetical protein FLJ32370 | Hypothetical protein | 1347 | 5315 |
| Contig50324_RC | LOC51044 | CDNA FLJ25011 fis, clone CBL01244 | | 1348 | 5316 |
| Contig50337_RC | MGC4645 | hypothetical protein MGC4645 | Hypothetical protein, Repeat, WD repeat | 1349 | 5317 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig50381_RC | CD109 | CD109 antigen (Gov platelet alloantigens) | Hypothetical protein | 1350 | 5318 |
| Contig50391_RC | | Transcribed sequence with moderate similarity to protein ref: NP_060312.1 (*H. sapiens*) hypothetical protein FLJ20489 [*Homo sapiens*] | | 1351 | 5319 |
| Contig50436_RC | | CDNA FLJ37094 fis, clone BRACE2018337 | | 1352 | 5320 |
| Contig50465_RC | | Transcribed sequences | | 1353 | 5321 |
| Contig50483 | KIAA1718 | KIAA1718 protein | Hypothetical protein | 1354 | 5322 |
| Contig50490_RC | LOC90678 | leucine rich repeat and sterile alpha motif containing 1 | Hypothetical protein | 1355 | 5323 |
| Contig50501_RC | | coronin, actin binding protein, 2A | Actin-binding, Repeat, WD repeat, Coiled coil | 1356 | 5324 |
| Contig50595_RC | | hypothetical protein LOC147111 | Hypothetical protein | 1357 | 5325 |
| Contig50605_RC | | wj49g02.x1 NCI_CGAP_Lu19 *Homo sapiens* cDNA clone IMAGE: 2406194 3', mRNA sequence. | | 1358 | 5326 |
| Contig50669_RC | KIF9 | kinesin family member 9 | Hypothetical protein, Motor protein, Microtubule, ATP-binding, Coiled coil, Alternative splicing | 1359 | 5327 |
| Contig50675 | BA108L7.2 | similar to rat tricarboxylate carrier-like protein | Hypothetical protein, Transport, Iron transport, Mitochondrion, Transmembrane | 1360 | 5328 |
| Contig50687_RC | MINA53 | hypothetical protein DKFZp667G2110 | Hypothetical protein | 1361 | 5329 |
| Contig506_RC | KIAA1821 | rab11-family interacting protein 4 | Hypothetical protein | 1362 | 5330 |
| Contig50728_RC | | Transcribed sequence with weak similarity to protein ref: NP_071385.1 (*H. sapiens*) hypothetical protein FLJ20958 [*Homo sapiens*] | | 1363 | 5331 |
| Contig50747_RC | MGC23427 | BTB (POZ) domain containing 14A | | 1364 | 5332 |
| Contig50759 | DKFZp761P1121 | hypothetical protein DKFZp761P1121 | Hypothetical protein, RNA-binding, Repeat, Alternative splicing | 1365 | 5333 |
| Contig50787_RC | FLJ31528 | hypothetical protein FLJ31528 | Hypothetical protein | 1366 | 5334 |
| Contig50814_RC | MGC27027 | immune associated nucleotide | Hypothetical protein | 1367 | 5335 |
| Contig50831_RC | | LOC389865 (LOC389865), mRNA | | 1368 | 5336 |
| Contig50838_RC | LOC120224 | hypothetical protein BC016153 | Hypothetical protein | 1369 | 5337 |
| Contig50846_RC | | zinc finger CCCH type domain containing 5 | Hypothetical protein | 1370 | 5338 |
| Contig50848_RC | KIAA1705 | DDHD domain containing 1 | Lipid degradation, Hydrolase, Alternative splicing | 1371 | 5339 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig50891_RC | | *Homo sapiens*, p21/Cdc42/Rac1-activated kinase 1 (STE20 homolog, yeast), clone MGC: 51883 IMAGE: 5763796, mRNA, complete cds. | ATP-binding, Kinase, Serine/threonine-protein kinase, Transferase, Apoptosis, Phosphorylation, 3D-structure | 1372 | 5340 |
| Contig50905_RC | | CDNA FLJ42250 fis, clone TKIDN2007828 | | 1373 | 5341 |
| Contig50920_RC | KIAA1847 | *Homo sapiens* mRNA for KIAA1847 protein, partial cds. | Hypothetical protein, Zinc-finger, Alternative splicing | 1374 | 5342 |
| Contig51020_RC | MGC21874 | transcriptional adaptor 2 (ADA2 homolog, yeast)-beta | Hypothetical protein | 1375 | 5343 |
| Contig51026_RC | DKFZp762A2013 | quiescin Q6-like 1 | Hypothetical protein, Signal | 1376 | 5344 |
| Contig51068_RC | | CDNA clone IMAGE: 5286843, partial cds | | 1377 | 5345 |
| Contig51070_RC | FLJ25005 | FLJ25005 protein | Hypothetical protein | 1378 | 5346 |
| Contig51087_RC | NPEPL1 | aminopeptidase-like 1 | Hydrolase, Aminopeptidase, Zinc, Manganese, Alternative splicing | 1379 | 5347 |
| Contig51103_RC | JFC1 | NADPH oxidase-related, C2 domain-containing protein | Hypothetical protein, Repeat, Alternative splicing | 1380 | 5348 |
| Contig51105_RC | | Transcribed sequence with weak similarity to protein ref: NP_062553.1 (*H. sapiens*) hypothetical protein FLJ11267 [*Homo sapiens*] | | 1381 | 5349 |
| Contig51128_RC | MGC35182 | hypothetical protein MGC35182 | Hypothetical protein | 1382 | 5350 |
| Contig51151_RC | ASP | AKAP-associated sperm protein | | 1383 | 5351 |
| Contig51163_RC | | hypothetical protein MGC45871 | Hypothetical protein | 1384 | 5352 |
| Contig51170_RC | | bruno-like 4, RNA binding protein (*Drosophila*) | Hypothetical protein | 1385 | 5353 |
| Contig51254_RC | CLG | likely ortholog of mouse common-site lymphoma/leukemia GEF | Hypothetical protein | 1386 | 5354 |
| Contig51288_RC | NR2C2 | nuclear receptor subfamily 2, group C, member 2 | Receptor, Transcription regulation, DNA-binding, Nuclear protein, Zinc-finger | 1387 | 5355 |
| Contig51291_RC | KIAA1977 | KIAA1977 protein | Hypothetical protein, ANK repeat, Repeat | 1388 | 5356 |
| Contig51297_RC | FLJ33817 | hypothetical protein FLJ33817 | Hypothetical protein, Repeat, WD repeat | 1389 | 5357 |
| Contig51311_RC | KDELC1 | KDEL (Lys-Asp-Glu-Leu) containing 1 | Hypothetical protein | 1390 | 5358 |
| Contig51373_RC | KIAA1688 | KIAA1688 protein | Repeat | 1391 | 5359 |
| Contig51414_RC | FLJ23441 | hypothetical protein FLJ23441 | Hypothetical protein | 1392 | 5360 |
| Contig51417_RC | SHANK3 | SH3 and multiple ankyrin repeat domains 3 | SH3-binding, Coiled coil, Chromosomal translocation | 1393 | 5361 |
| Contig51449_RC | | RAB15, member RAS onocogene family | Hypothetical protein, Plasmid | 1394 | 5362 |
| Contig51519_RC | | spastic paraplegia 6 (autosomal dominant) | Hypothetical protein | 1395 | 5363 |
| Contig51526_RC | RAB39B | RAB39B, member RAS oncogene family | GTP-binding, Lipoprotein, Prenylation, Transport, Protein transport | 1396 | 5364 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig51553_RC | MGC3200 | hypothetical protein MGC3200 | Hypothetical protein | 1397 | 5365 |
| Contig51567_RC | | hypothetical protein MGC33371 | Hypothetical protein | 1398 | 5366 |
| Contig51621_RC | | ubiquitin specific protease 13 (isopeptidase T-3) | Hypothetical protein, Ubl conjugation pathway, Hydrolase, Thiol protease, Multigene family, Repeat | 1399 | 5367 |
| Contig51625_RC | | Clone IMAGE: 3868989, mRNA, partial cds | Hypothetical protein | 1400 | 5368 |
| Contig51660_RC | IFRG28 | 28 kD interferon responsive protein | Transmembrane | 1401 | 5369 |
| Contig51687_RC | KRTDAP | KIPV467 | | 1402 | 5370 |
| Contig51723_RC | | Splicing factor, arginine/serine-rich, 46 kD | | 1403 | 5371 |
| Contig51726_RC | FLJ20739 | Transcribed sequence with weak similarity to protein pir: S41161 (*H. sapiens*) S41161 keratin 9, cytoskeletal - human | Hypothetical protein | 1404 | 5372 |
| Contig51737_RC | | CDNA FLJ38931 fis, clone NT2NE2013189 | | 1405 | 5373 |
| Contig51740_RC | FLJ33282 | amyotrophic lateral sclerosis 2 (juvenile) chromosome region, candidate 4 | Hypothetical protein | 1406 | 5374 |
| Contig51742_RC | RISC | likely homolog of rat and mouse retinoid-inducible serine carboxypeptidase | Hydrolase, Carboxypeptidase, Signal, Glycoprotein, Alternative splicing | 1407 | 5375 |
| Contig51757 | | lin-7 homolog A (*C. elegans*) | | 1408 | 5376 |
| Contig51795_RC | TGFBI | CDNA FLJ37830 fis, clone BRSSN2009395 | Extracellular matrix, Signal, Repeat, Cell adhesion, Disease mutation, Amyloid, Vision | 1409 | 5377 |
| Contig51800 | | Transcribed sequence with strong similarity to protein pdb: 1BGM (*E. coli*) O Chain O, Beta-Galactosidase | | 1410 | 5378 |
| Contig51809_RC | C21orf63 | chromosome 21 open reading frame 63 | Signal, Transmembrane, Repeat, Glycoprotein, Lectin, Alternative splicing | 1411 | 5379 |
| Contig51821_RC | TAF4B | TAF4b RNA polymerase II, TATA box binding protein (TBP)-associated factor, 105 kDa | Transcription regulation, Nuclear protein | 1412 | 5380 |
| Contig51882_RC | MGC11335 | hypothetical protein MGC11335 | Hypothetical protein | 1413 | 5381 |
| Contig51888_RC | | pannexin 1 | Gap junction, Transmembrane, Polymorphism | 1414 | 5382 |
| Contig51896_RC | HT021 | HT021 | | 1415 | 5383 |
| Contig51917_RC | WBSCR14 | Full length insert cDNA clone YI46G04 | Transcription regulation, Repressor, Nuclear protein, DNA-binding, Williams-Beuren syndrome, Alternative splicing | 1416 | 5384 |
| Contig51929 | | PAI-1 mRNA-binding protein | Hypothetical protein | 1417 | 5385 |
| Contig51964_RC | FLJ40629 | hypothetical protein FLJ40629 | Hypothetical protein | 1418 | 5386 |
| Contig51967_RC | | solute carrier family 16 (monocarboxylic acid transporters), member 6 | Transport, Symport, Transmembrane, Multigene family | 1419 | 5387 |
| Contig51974_RC | | Transcribed sequences | Hypothetical protein, Phospholipid biosynthesis, Transferase, Acyltransferase, Transmembrane | 1420 | 5388 |
| Contig52062_RC | FLJ31978 | hypothetical protein FLJ31978 | Hypothetical protein | 1421 | 5389 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig52099_RC | | CDNA FLJ41881 fis, clone OCBBF2021833 | | 1422 | 5390 |
| Contig52186_RC | | zinc finger protein 67 homolog (mouse) | Metal-binding, Zinc, Zinc-finger | 1423 | 5391 |
| Contig52199_RC | | CDNA FLJ12540 fis, clone NT2RM4000425 | | 1424 | 5392 |
| Contig52220_RC | | CDNA FLJ25573 fis, clone JTH06531 | | 1425 | 5393 |
| Contig52232_RC | DERMO1 | twist homolog 2 (Drosophila) | Differentiation, Developmental protein, Nuclear protein, DNA-binding, Repressor, Transcription regulation | 1426 | 5394 |
| Contig52242_RC | | CDNA FLJ12345 fis, clone MAMMA1002294 | Hypothetical protein | 1427 | 5395 |
| Contig52312_RC | TFEB | transcription factor EB | Transcription regulation, DNA-binding, Nuclear protein, Alternative splicing | 1428 | 5396 |
| Contig52317_RC | | hypothetical protein LOC91942 | Hypothetical protein, Ubiquinone | 1429 | 5397 |
| Contig52320 | | Full length insert cDNA clone YX81F03 | | 1430 | 5398 |
| Contig52336_RC | MGC2488 | homolog of yeast Mis12 | Hypothetical protein | 1431 | 5399 |
| Contig52358_RC | | Transcribed sequences | | 1432 | 5400 |
| Contig52405_RC | EDG3 | endothelial differentiation, sphingolipid G-protein-coupled receptor, 3 | G-protein coupled receptor, Transmembrane, Glycoprotein | 1433 | 5401 |
| Contig52414_RC | CAMTA1 | calmodulin binding transcription activator 1 | Hypothetical protein, ANK repeat, Repeat | 1434 | 5402 |
| Contig52443 | | hypothetical protein INM01 | | 1435 | 5403 |
| Contig52482_RC | PNPASE | polyribonucleotide nucleotidyltransferase 1 | Hypothetical protein, Exonuclease, Nucleotidyltransferase, Transferase | 1436 | 5404 |
| Contig52486_RC | PPARAL | CDNA FLJ31089 fis, clone IMR321000092 | | 1437 | 5405 |
| Contig52520_RC | | MRNA full length insert cDNA clone EUROIMAGE 2068962 | | 1438 | 5406 |
| Contig52544_RC | MGC17515 | hypothetical protein MGC17515 | Hypothetical protein | 1439 | 5407 |
| Contig52553_RC | LOC197336 | similar to RIKEN cDNA 3230401M21 [Mus musculus] | Hypothetical protein, Repeat, WD repeat | 1440 | 5408 |
| Contig52561_RC | | Cas-Br-M (murine) ecotropic retroviral transforming sequence | Hypothetical protein, Ligase, Ubl conjugation pathway, Proto-oncogene, Zinc-finger, SH2 domain, Phosphorylation, Calcium-binding, 3D-structure | 1441 | 5409 |
| Contig52565_RC | | MAX dimerization protein 1 | Nuclear protein, DNA-binding, Transcription regulation, Repressor, 3D-structure | 1442 | 5410 |
| Contig52570_RC | | CDNA FLJ41853 fis, clone NT2RI3004161 | | 1443 | 5411 |
| Contig52579_RC | | breast cancer membrane protein 101 | | 1444 | 5412 |
| Contig52609_RC | | hypothetical protein FLJ33814 | Hypothetical protein | 1445 | 5413 |
| Contig52623_RC | FLJ12888 | chromosome 9 open reading frame 76 | Hypothetical protein | 1446 | 5414 |
| Contig52648_RC | MGC2404 | acyl-Coenzyme A binding domain containing 6 | ANK repeat, Repeat | 1447 | 5415 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig52659_RC | | hypothetical protein LOC255104 | Hypothetical protein | 1448 | 5416 |
| Contig52715_RC | | Transcribed sequences | | 1449 | 5417 |
| Contig52720_RC | MGC2714 | hypothetical protein MGC2714 | Hypothetical protein | 1450 | 5418 |
| Contig52729_RC | MGC3020 | hypothetical protein MGC3020 | Hypothetical protein | 1451 | 5419 |
| Contig5274_RC | C21orf91 | chromosome 21 open reading frame 91 | Polymorphism | 1452 | 5420 |
| Contig52777_RC | | Transcribed sequence with strong similarity to protein ref: NP_286085.1 (*E. coli*) beta-D-galactosidase [*Escherichia coli* O157:H7 EDL933] | | 1453 | 5421 |
| Contig52786_RC | ZNF198 | zinc finger protein 198 | Hypothetical protein, Transcription regulation, Nuclear protein, Chromosomal translocation, Repeat, Zinc-finger | 1454 | 5422 |
| Contig52792_RC | MGC3062 | phosducin-like 3 | | 1455 | 5423 |
| Contig52814_RC | | Transcribed sequences | | 1456 | 5424 |
| Contig52891_RC | | membrane associated guanylate kinase interacting protein-like 1 | Hypothetical protein | 1457 | 5425 |
| Contig52914_RC | MGC4663 | cytochrome P450, family 2, subfamily R, polypeptide 1 | Hypothetical protein | 1458 | 5426 |
| Contig52924_RC | FLJ14827 | hypothetical protein FLJ14827 | Hypothetical protein | 1459 | 5427 |
| Contig52932_RC | DKFZP566D1346 | hypothetical protein DKFZp566D1346 | Hypothetical protein, ANK repeat, Repeat | 1460 | 5428 |
| Contig52945_RC | KIAA1946 | KIAA1946 protein | Hypothetical protein | 1461 | 5429 |
| Contig52971_RC | SCAMP5 | secretory carrier membrane protein 5 | Hypothetical protein | 1462 | 5430 |
| Contig52993_RC | MAP3K3 | mitogen-activated protein kinase kinase kinase 3 | Hypothetical protein, ATP-binding, Transferase, Serine/threonine-protein kinase | 1463 | 5431 |
| Contig52994_RC | | Transcribed sequence with weak similarity to protein ref: NP_055301.1 (*H. sapiens*) neuronal thread protein [*Homo sapiens*] | | 1464 | 5432 |
| Contig53047_RC | TTYH1 | tweety homolog 1 (*Drosophila*) | | 1465 | 5433 |
| Contig53066_RC | ARL5 | ADP-ribosylation factor-like 5 | GTP-binding, Multigene family | 1466 | 5434 |
| Contig53072_RC | KIAA1474 | zinc finger protein 537 | Hypothetical protein, Metal-binding, Zinc, Zinc-finger | 1467 | 5435 |
| Contig53080_RC | | CDNA FLJ31655 fis, clone NT2RI2004284 | | 1468 | 5436 |
| Contig53149_RC | RIN3 | Ras and Rab interactor 3 | GTPase activation, SH2 domain, Alternative splicing, Plasmid | 1469 | 5437 |
| Contig53177_RC | | CDNA FLJ90571 fis, clone OVARC1001725, highly similar to *Homo sapiens* patched related protein TRC8 (TRC8) gene. | | 1470 | 5438 |
| Contig53211_RC | FLJ11588 | hypothetical protein FLJ11588 | Hypothetical protein | 1471 | 5439 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig53223 | PPP1R15B | protein phosphatase 1, regulatory (inhibitor) subunit 15B | Hypothetical protein | 1472 | 5440 |
| Contig53226_RC | | hypothetical protein DKFZp762C1112 | Hypothetical protein | 1473 | 5441 |
| Contig53243_RC | | hypothetical protein LOC257106 | Hypothetical protein | 1474 | 5442 |
| Contig53253_RC | WWP2 | Nedd-4-like ubiquitin-protein ligase | Ubl conjugation pathway, Ligase, Repeat | 1475 | 5443 |
| Contig53260_RC | | hypothetical protein LOC196264 | Hypothetical protein | 1476 | 5444 |
| Contig53307_RC | LOC51184 | *Homo sapiens* mRNA full length insert cDNA clone EUROIMAGE 1635059. | Hypothetical protein | 1477 | 5445 |
| Contig53323 | KIAA1608 | KIAA1608 | Hypothetical protein | 1478 | 5446 |
| Contig53342_RC | | Transcribed sequences | | 1479 | 5447 |
| Contig53349_RC | FLJ12287 | hypothetical protein FLJ12287 similar to semaphorins | Hypothetical protein, Signal, Transmembrane, Immunoglobulin domain, Multigene family, Neurogenesis, Developmental protein, Glycoprotein | 1480 | 5448 |
| Contig53355_RC | MGC10870 | hypothetical protein MGC10870 | | 1481 | 5449 |
| Contig53410_RC | FLJ14596 | chromosome 9 open reading frame 54 | Hypothetical protein | 1482 | 5450 |
| Contig53439_RC | FLJ22457 | hypothetical protein FLJ22457 | Hypothetical protein | 1483 | 5451 |
| Contig53460_RC | | CDNA FLJ30010 fis, clone 3NB692000154 | | 1484 | 5452 |
| Contig5348_RC | | Transcribed sequence with weak similarity to protein sp: Q13892 (*H. sapiens*) BT33_HUMAN Transcription factor BTF3 homolog 3 | | 1485 | 5453 |
| Contig53517_RC | PJA1 | praja 1 | Ubl conjugation pathway, Ligase, Zinc-finger, Alternative splicing | 1486 | 5454 |
| Contig53555_RC | | myotubularin related protein 3 | Hydrolase, Zinc-finger, Alternative splicing, Hypothetical protein | 1487 | 5455 |
| Contig53566_RC | LANCL2 | LanC lantibiotic synthetase component C-like 2 (bacterial) | Hypothetical protein | 1488 | 5456 |
| Contig53585_RC | CG005 | phosphonoformate immuno-associated protein 5 | Hypothetical protein | 1489 | 5457 |
| Contig53615_RC | MGC4692 | hypothetical protein LOC283871 | | 1490 | 5458 |
| Contig53635_RC | FLJ39514 | sec1 family domain containing 2 | Hypothetical protein | 1491 | 5459 |
| Contig53641_RC | MAGE-E1 | melanoma antigen, family D, 4 | Hypothetical protein | 1492 | 5460 |
| Contig53696_RC | MDS006 | x 006 protein | | 1493 | 5461 |
| Contig53709_RC | | adaptor-related protein complex 1, gamma 1 subunit | Golgi stack, Protein transport, Transport, Coated pits, Endocytosis, Polymorphism, 3D-structure, Hypothetical protein | 1494 | 5462 |
| Contig53719_RC | FLJ30596 | hypothetical protein FLJ30596 | Hypothetical protein | 1495 | 5463 |
| Contig53746_RC | DRLM | nucleosome assembly protein 1-like 5 | Hypothetical protein | 1496 | 5464 |
| Contig53819_RC | MGC11296 | breast cancer metastasis-suppressor 1-like | | 1497 | 5465 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig53823_RC | FLJ31295 | hypothetical protein FLJ31295 | Metal-binding, Zinc, Zinc-finger, Hypothetical protein | 1498 | 5466 |
| Contig53829 | MGC3123 | hypothetical protein MGC3123 | Hypothetical protein | 1499 | 5467 |
| Contig53852_RC | KIAA1577 | zinc finger, SWIM domain containing 6 | Hypothetical protein | 1500 | 5468 |
| Contig53884_RC | LOC59346 | PDZ and LIM domain 2 (mystique) | Hypothetical protein, LIM domain, Metal-binding, Zinc | 1501 | 5469 |
| Contig53909_RC | MGC23947 | hypothetical protein MGC23947 | Hypothetical protein | 1502 | 5470 |
| Contig5392_RC | | Transcribed sequences | | 1503 | 5471 |
| Contig53944_RC | MI-ER1 | putative NFkB activating protein 373 | Hypothetical protein | 1504 | 5472 |
| Contig53985_RC | FLJ30596 | hypothetical protein FLJ30596 | Hypothetical protein | 1505 | 5473 |
| Contig54010_RC | MDS024 | chromosome 6 open reading frame 75 | | 1506 | 5474 |
| Contig54012_RC | SAS10 | MRNA; cDNA DKFZp686C2051 (from clone DKFZp686C2051) | Hypothetical protein | 1507 | 5475 |
| Contig54048_RC | GC1 | solute carrier family 25 (mitochondrial carrier: glutamate), member 22 | Mitochondrion, Inner membrane, Repeat, Transmembrane, Transport, Symport | 1508 | 5476 |
| Contig54066_RC | DEDD2 | death effector domain containing 2 | DNA-binding, Hypothetical protein | 1509 | 5477 |
| Contig54110_RC | | splicing factor, arginine/serine-rich 1 (splicing factor 2, alternate splicing factor) | mRNA processing, mRNA splicing, Nuclear protein, RNA-binding, Repeat, Alternative splicing, Acetylation, Phosphorylation | 1510 | 5478 |
| Contig54113_RC | FLJ11785 | Rad50-interacting protein 1 | Hypothetical protein | 1511 | 5479 |
| Contig54137_RC | | zinc finger protein 84 (HPF2) | Transcription regulation, DNA-binding, Zinc-finger, Metal-binding, Nuclear protein, Repeat | 1512 | 5480 |
| Contig54184_RC | MGC955 | hypothetical protein MGC955 | Hypothetical protein | 1513 | 5481 |
| Contig54317_RC | MGC29956 | hypothetical protein MGC29956 | Hypothetical protein | 1514 | 5482 |
| Contig54321_RC | DDX33 | DEAH (Asp-Glu-Ala-His) box polypeptide 33 | Hypothetical protein, ATP-binding, Helicase, Hydrolase | 1515 | 5483 |
| Contig54342_RC | MGC13096 | hypothetical protein MGC13096 | Cytokine, Disease mutation, Gluconeogenesis, Glycolysis, Growth factor, Isomerase, Neurone | 1516 | 5484 |
| Contig54371_RC | GKAP42 | protein kinase anchoring protein GKAP42 | Hypothetical protein, Kinase | 1517 | 5485 |
| Contig54463_RC | | CDNA FLJ12874 fis, clone NT2RP2003769 | | 1518 | 5486 |
| Contig54503_RC | | kelch-like 11 (*Drosophila*) | Hypothetical protein | 1519 | 5487 |
| Contig54531_RC | | *Homo sapiens* cDNA FLJ38849 fis, clone MESAN2008936. | | 1520 | 5488 |
| Contig54559_RC | | ankyrin repeat and BTB (POZ) domain containing 1 | ANK repeat, Repeat | 1521 | 5489 |
| Contig54563_RC | KNSL5 | kinesin family member 23 | Motor protein, Cell division, Microtubule, ATP-binding, Coiled coil, Mitosis, Cell cycle, Nuclear protein | 1522 | 5490 |
| Contig54581_RC | | tumor suppressor TSBF1 | | 1523 | 5491 |
| Contig54609_RC | PANK3 | pantothenate kinase 3 | Transferase, Kinase, ATP-binding, Coenzyme A biosynthesis | 1524 | 5492 |
| Contig54614_RC | FLJ14007 | hypothetical protein FLJ14007 | Hypothetical protein | 1525 | 5493 |
| Contig54659_RC | HCCA2 | HCCA2 protein | Hypothetical protein | 1526 | 5494 |

TABLE 8-continued

The phase reporter genes

| SUBS | GENE | DESCRIPTION | SP_XREF_KEYWORD_LIST | SEQ ID NO. | PROBE SEQ ID NO. |
| --- | --- | --- | --- | --- | --- |
| Contig54667_RC | ERAP140 | nuclear receptor coactivator 7 | Receptor, Hypothetical protein | 1527 | 5495 |
| Contig54680_RC | | nucleotide-binding oligomerization domains 27 | Hypothetical protein | 1528 | 5496 |
| Contig54686_RC | | zinc finger protein 598 | Hypothetical protein | 1529 | 5497 |
| Contig54716_RC | KIAA0863 | KIAA0863 protein | Hypothetical protein, Metal-binding, Zinc, Zinc-finger | 1530 | 5498 |
| Contig54718_RC | FLJ37562 | hypothetical protein FLJ37562 | Hypothetical protein | 1531 | 5499 |
| Contig54729_RC | | chromosome 10 open reading frame 30 | Hypothetical protein | 1532 | 5500 |
| Contig54751_RC | VIK | vav-1 interacting Kruppel-like protein | Metal-binding, Zinc, Zinc-finger, Hypothetical protein | 1533 | 5501 |
| Contig54757_RC | | hypothetical protein LOC129293 | Hypothetical protein | 1534 | 5502 |
| Contig54802_RC | GPR108 | G protein-coupled receptor 108 | Hypothetical protein | 1535 | 5503 |
| Contig54829_RC | TJP3 | tight junction protein 3 (zona occludens 3) | Hypothetical protein | 1536 | 5504 |
| Contig54893_RC | APOBEC3G | apolipoprotein B mRNA editing enzyme, catalytic polypeptide-like 3G | Hypothetical protein | 1537 | 5505 |
| Contig54915_RC | DR1 | Hypothetical gene supported by AL832786 (LOC400762), mRNA | Transcription, Phosphorylation, Nuclear protein, 3D-structure | 1538 | 5506 |
| Contig54932_RC | BIVM | basic, immunoglobulin-like variable motif containing | Hypothetical protein | 1539 | 5507 |
| Contig54961_RC | | lemur tyrosine kinase 2 | Hypothetical protein, ATP-binding, Kinase, Transferase, Tyrosine-protein kinase | 1540 | 5508 |
| Contig5498_RC | C17orf26 | solute carrier family 39 (metal ion transporter), member 11 | Hypothetical protein | 1541 | 5509 |
| Contig54999_RC | FLJ12994 | hypothetical protein FLJ12994 | Hypothetical protein | 1542 | 5510 |
| Contig55004 | DKFZP564O0463 | mitochondrial folate transporter/carrier | Mitochondrion, Inner membrane, Repeat, Transmembrane, Transport | 1543 | 5511 |
| Contig55022_RC | ALP | asparaginase like 1 | Hypothetical protein | 1544 | 5512 |
| Contig55038_RC | MCOLN1 | mucolipin 1 | Ionic channel, Transmembrane, Hypothetical protein | 1545 | 5513 |
| Contig55044_RC | DECR2 | 2,4-dienoyl CoA reductase 2, peroxisomal | Oxidoreductase, Hypothetical protein | 1546 | 5514 |
| Contig55069_RC | | Hypothetical gene supported by BC040598 (LOC400960), mRNA | | 1547 | 5515 |
| Contig55079_RC | FLJ21613 | corneal wound healing-related protein | Hypothetical protein | 1548 | 5516 |
| Contig55114_RC | | chromosome 6 open reading frame 89 | Hypothetical protein | 1549 | 5517 |
| Contig55121_RC | P5326 | hypothetical protein p5326 | Hypothetical protein | 1550 | 5518 |
| Contig5513_RC | | Transcribed sequences | | 1551 | 5519 |
| Contig55181_RC | LOC115509 | hypothetical protein BC014000 | Hypothetical protein, Metal-binding, Zinc, Zinc-finger | 1552 | 5520 |
| Contig55193_RC | HS6ST1 | heparan sulfate 6-O-sulfotransferase 1 | Transferase | 1553 | 5521 |
| Contig55254_RC | LOC220074 | Hypothetical 55.1 kDa protein F09G8.5 in chromosome III | | 1554 | 5522 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig55265_RC | | ets variant gene 6 (TEL oncogene) | Transcription regulation, Repressor, Nuclear protein, DNA-binding, Phosphorylation, Proto-oncogene, Chromosomal translocation, 3D-structure | 1555 | 5523 |
| Contig55334_RC | DKFZp547C195 | hypothetical protein DKFZp547C195 | Hypothetical protein | 1556 | 5524 |
| Contig55337_RC | MGC2454 | chromosome 2 open reading frame 8 | Hypothetical protein, Methyltransferase, Transferase | 1557 | 5525 |
| Contig55351_RC | | hypothetical protein MGC45871 | Hypothetical protein | 1558 | 5526 |
| Contig55365_RC | | CDNA clone IMAGE: 6702802, partial cds | | 1559 | 5527 |
| Contig55375_RC | C1QTNF6 | C1q and tumor necrosis factor related protein 6 | Collagen, Signal | 1560 | 5528 |
| Contig55377_RC | DKFZp761H0421 | RUN domain containing 1 | Hypothetical protein | 1561 | 5529 |
| Contig55397_RC | CSPG6 | sterile alpha motif domain containing 6 | Hypothetical protein, ANK repeat, Repeat | 1562 | 5530 |
| Contig55468_RC | | solute carrier family 9 (sodium/hydrogen exchanger), isoform 9 | Hypothetical protein | 1563 | 5531 |
| Contig55487_RC | | solute carrier family 39 (zinc transporter), member 10 | Hypothetical protein | 1564 | 5532 |
| Contig55522 | | LOC400236 (LOC400236), mRNA | | 1565 | 5533 |
| Contig55539_RC | | GAAI470 | Hypothetical protein | 1566 | 5534 |
| Contig55574_RC | KIAA1940 | KIAA1940 protein | Hypothetical protein | 1567 | 5535 |
| Contig55575_RC | SDS3 | likely ortholog of mouse Sds3 | Hypothetical protein | 1568 | 5536 |
| Contig55618_RC | MGC4825 | hypothetical protein MGC4825 | Hypothetical protein | 1569 | 5537 |
| Contig55671_RC | | nuclear factor of activated T-cells, cytoplasmic, calcineurin-dependent 2 | Transcription regulation, Activator, Nuclear protein, DNA-binding, Alternative splicing, Phosphorylation, Repeat, 3D-structure | 1570 | 5538 |
| Contig55674_RC | DUSP16 | LOC387840 (LOC387840), mRNA | Hydrolase, Nuclear protein, Hypothetical protein | 1571 | 5539 |
| Contig55709_RC | | chromosome 14 open reading frame 35 | | 1572 | 5540 |
| Contig55712_RC | | hypothetical protein LOC286257 | Hypothetical protein | 1573 | 5541 |
| Contig55744_RC | DIRC2 | disrupted in renal carcinoma 2 | Hypothetical protein | 1574 | 5542 |
| Contig55759_RC | | hypothetical protein LOC145758 | Repeat, ANK repeat, Alternative splicing | 1575 | 5543 |
| Contig55766_RC | TOMM70A | hypothetical protein LOC348801 | Mitochondrion, Outer membrane, Transmembrane, Repeat, TPR repeat | 1576 | 5544 |
| Contig55767_RC | FLJ22662 | hypothetical protein FLJ22662 | Hypothetical protein | 1577 | 5545 |
| Contig55814_RC | | protein containing single MORN motif in testis | | 1578 | 5546 |
| Contig55886_RC | | zinc finger protein 181 (HHZ181) | | 1579 | 5547 |
| Contig55940_RC | MGC13010 | hypothetical protein MGC13010 | Hypothetical protein | 1580 | 5548 |
| Contig55944_RC | FLJ20958 | MRNA; cDNA DKFZp686A1197 (from clone DKFZp686A1197) | Hypothetical protein | 1581 | 5549 |
| Contig55950_RC | FLJ22329 | hypothetical protein FLJ22329 | Hypothetical protein | 1582 | 5550 |
| Contig55966_RC | DKFZP762N2316 | zinc finger protein 462 | Hypothetical protein, Metal-binding, Zinc, Zinc-finger | 1583 | 5551 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig55979_RC | MGC14136 | chromosome 21 open reading frame 119 | Hypothetical protein | 1584 | 5552 |
| Contig55_RC | | protein kinase, AMP-activated, beta 2 non-catalytic subunit | Fatty acid biosynthesis, Phosphorylation | 1585 | 5553 |
| Contig56036_RC | CD47 | CD47 antigen (Rh-related antigen, integrin-associated signal transducer) | Integrin, Cell adhesion, Antigen, Signal, Transmembrane, Glycoprotein, Alternative splicing | 1586 | 5554 |
| Contig56052_RC | | hypothetical protein LOC203547 | | 1587 | 5555 |
| Contig56056_RC | TRUB1 | TruB pseudouridine (psi) synthase homolog 1 (E. coli) | | 1588 | 5556 |
| Contig56061_RC | DEF6 | differentially expressed in FDCP 6 homolog (mouse) | | 1589 | 5557 |
| Contig56082_RC | RNU2 | *Homo sapiens* mRNA; cDNA DKFZp666D074 (from clone DKFZp666D074). | Hypothetical protein | 1590 | 5558 |
| Contig56147_RC | | hypothetical protein LOC338799 | Hypothetical protein | 1591 | 5559 |
| Contig56167_RC | BAALC | brain and acute leukemia, cytoplasmic | Hypothetical protein | 1592 | 5560 |
| Contig56179_RC | MGC15523 | hypothetical protein MGC15523 | Hypothetical protein | 1593 | 5561 |
| Contig56229 | | likely ortholog of mouse zinc finger protein EZI | Hypothetical protein | 1594 | 5562 |
| Contig56234_RC | IMAGE3451454 | SVAP1 protein | Hypothetical protein | 1595 | 5563 |
| Contig56242_RC | FLJ23221 | hypothetical protein FLJ23221 | Hypothetical protein | 1596 | 5564 |
| Contig56253_RC | FLJ21087 | brix domain containing 1 | Nuclear protein | 1597 | 5565 |
| Contig56263_RC | FLJ21080 | SET and MYND domain containing 3 | Zinc-finger, Hypothetical protein | 1598 | 5566 |
| Contig56298_RC | FLJ13154 | hypothetical protein FLJ13154 | Hypothetical protein | 1599 | 5567 |
| Contig56303_RC | LOC51112 | v-abl Abelson murine leukemia viral oncogene homolog 2 (arg, Abelson-related gene) | Transferase, Tyrosine-protein kinase, Proto-oncogene, ATP-binding, Phosphorylation, SH2 domain, SH3 domain, Alternative splicing | 1600 | 5568 |
| Contig56334_RC | RAI16 | retinoic acid induced 16 | Hypothetical protein | 1601 | 5569 |
| Contig56350_RC | MGC4607 | cerebral cavernous malformation 2 | Hypothetical protein | 1602 | 5570 |
| Contig56390_RC | MGC26847 | sushi domain containing 3 | | 1603 | 5571 |
| Contig56395_RC | FLJ14624 | hypothetical protein FLJ14624 | Hypothetical protein | 1604 | 5572 |
| Contig5639_RC | | phosphorylase, glycogen; liver (Hers disease, glycogen storage disease type VI) | Transferase, Glycosyltransferase, Carbohydrate metabolism, Glycogen metabolism, Allosteric enzyme, Pyridoxal phosphate, Phosphorylation, Glycogen storage disease, Disease mutation, Polymorphism, 3D-structure | 1605 | 5573 |
| Contig56503_RC | MGC9753 | CAB2 protein | Hypothetical protein | 1606 | 5574 |
| Contig56527_RC | | FLJ20758 protein | Hypothetical protein | 1607 | 5575 |
| Contig56541_RC | LSFR2 | dolichyl pyrophosphate phosphatase 1 | | 1608 | 5576 |
| Contig56544_RC | H3F3A | hypothetical protein FLJ20403 | Nuclear protein, Chromosomal protein, DNA-binding, Nucleosome core, Multigene family | 1609 | 5577 |
| Contig56572_RC | DKFZP564B1162 | hypothetical protein DKFZp564B1162 | Hypothetical protein | 1610 | 5578 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig56583_RC | PF20 | PF20 | Repeat, WD repeat, Hypothetical protein | 1611 | 5579 |
| Contig56587_RC | HDAC10 | histone deacetylase 10 | Hydrolase, Nuclear protein, Chromatin regulator, Transcription regulation, Repressor, Polymorphism, Alternative splicing | 1612 | 5580 |
| Contig565_RC | | CDNA FLJ31683 fis, clone NT2RI2005353 | | 1613 | 5581 |
| Contig56623_RC | | Cas-Br-M (murine) ecotropic retroviral transforming sequence | Hypothetical protein, Ligase, Ubl conjugation pathway, Proto-oncogene, Zinc-finger, SH2 domain, Phosphorylation, Calcium-binding, 3D-structure | 1614 | 5582 |
| Contig56662_RC | MGC10963 | THAP domain containing 7 | Zinc-finger, DNA-binding | 1615 | 5583 |
| Contig56671_RC | FLJ12761 | mSin3A-associated protein 130 | Hypothetical protein | 1616 | 5584 |
| Contig56716_RC | KIAA1754 | KIAA1754 | Hypothetical protein | 1617 | 5585 |
| Contig56735_RC | | CDNA FLJ90790 fis, clone THYRO1001529, weakly similar to SERINE PALMITOYLTRANSFERASE 2 (EC 2.3.1.50). | Hypothetical protein | 1618 | 5586 |
| Contig56781_RC | MGC11349 | hypothetical protein MGC11349 | Hypothetical protein, Metal-binding, Zinc, Zinc-finger | 1619 | 5587 |
| Contig56823_RC | | Transcribed sequence with moderate similarity to protein ref: NP_060265.1 (*H. sapiens*) hypothetical protein FLJ20378 [*Homo sapiens*] | | 1620 | 5588 |
| Contig56944_RC | ASH1 | ash1 (absent, small, or homeotic)-like (*Drosophila*) | Hypothetical protein | 1621 | 5589 |
| Contig57011_RC | CDA11 | CDA11 protein | Hypothetical protein | 1622 | 5590 |
| Contig57017_RC | TFB2M | transcription factor B2, mitochondrial | Hypothetical protein | 1623 | 5591 |
| Contig57036_RC | | hypothetical protein LOC283445 | Fatty acid biosynthesis, Biotin, Ligase, Multifunctional enzyme, ATP-binding, Phosphorylation, Alternative splicing | 1624 | 5592 |
| Contig57057_RC | MAP3K3 | hypothetical protein MGC10986 | Hypothetical protein, LIM domain, Metal-binding, Zinc | 1625 | 5593 |
| Contig57076_RC | FBXO32 | F-box only protein 32 | Ubl conjugation pathway | 1626 | 5594 |
| Contig57081_RC | MSI2 | musashi homolog 2 (*Drosophila*) | Hypothetical protein | 1627 | 5595 |
| Contig57090_RC | | Full length insert cDNA clone YZ93G08 | | 1628 | 5596 |
| Contig5716_RC | | CDNA FLJ38396 fis, clone FEBRA2007957 | | 1629 | 5597 |
| Contig57173_RC | KIAA1737 | KIAA1737 | Hypothetical protein | 1630 | 5598 |
| Contig571_RC | ST6GALNAC6 | CMP-NeuAC: (beta)-N-acetylgalactosaminide (alpha)2,6-sialyltransferase member VI | Glycosyltransferase, Transferase, Hypothetical protein | 1631 | 5599 |
| Contig57226_RC | | tubulin, beta, 2 | GTP-binding, Hypothetical protein, Microtubule, Multigene family | 1632 | 5600 |
| Contig57239_RC | EPI64 | KIAA0114 gene product | Hypothetical protein | 1633 | 5601 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig57270_RC | ABCC4 | ATP-binding cassette, sub-family C (CFTR/MRP), member 4 | ATP-binding, Glycoprotein, Transmembrane, Transport, Repeat | 1634 | 5602 |
| Contig57290_RC | | hypothetical protein LOC286334 | | 1635 | 5603 |
| Contig57417 | LOC80298 | transcription termination factor-like protein | Hypothetical protein | 1636 | 5604 |
| Contig57436_RC | PPP2R5E | protein phosphatase 2, regulatory subunit B (B56), epsilon isoform | Phosphorylation, Multigene family | 1637 | 5605 |
| Contig57458_RC | IL6R | interleukin 6 receptor | Receptor, Transmembrane, Glycoprotein, Immunoglobulin domain, Repeat, Alternative splicing, Signal, 3D-structure | 1638 | 5606 |
| Contig57493_RC | MGC4399 | mitochondrial carrier protein | | 1639 | 5607 |
| Contig57562_RC | M11S1 | membrane component, chromosome 11, surface marker 1 | GPI-anchor | 1640 | 5608 |
| Contig57579 | ABTB1 | ankyrin repeat and BTB (POZ) domain containing 1 | ANK repeat, Repeat | 1641 | 5609 |
| Contig57625_RC | FLJ14225 | polycystic kidney disease 1-like | Hypothetical protein | 1642 | 5610 |
| Contig57822_RC | | CDNA clone IMAGE: 5286019, partial cds | | 1643 | 5611 |
| Contig57825_RC | MGC18216 | hypothetical protein MGC18216 | Hypothetical protein | 1644 | 5612 |
| Contig57840_RC | MBP | CDNA clone MGC: 70813 IMAGE: 6060520, complete cds | Hypothetical protein, Myelin, Structural protein, Acetylation, Methylation, Phosphorylation, Citrullination, Autoimmune encephalomyelitis, 3D-structure, Alternative splicing | 1645 | 5613 |
| Contig57957_RC | COL5A2 | similar to RIKEN cDNA 5730578N08 gene | Hypothetical protein | 1646 | 5614 |
| Contig58042_RC | | CDNA FLJ39602 fis, clone SKNSH2005061 | | 1647 | 5615 |
| Contig58113_RC | FLJ14005 | hypothetical protein LOC286044 | Hypothetical protein | 1648 | 5616 |
| Contig58123_RC | NFYB | nuclear transcription factor Y, beta | Transcription regulation, DNA-binding, Activator, Nuclear protein, 3D-structure | 1649 | 5617 |
| Contig58145_RC | YEA | solute carrier family 35, member B4 | Hypothetical protein | 1650 | 5618 |
| Contig58156_RC | C20orf167 | deoxynucleotidyltransferase, terminal, interacting protein 1 | Nuclear protein, Polymorphism | 1651 | 5619 |
| Contig58193_RC | TCF7L2 | transcription factor 7-like 2 (T-cell specific, HMG-box) | Transcription regulation, Activator, Repressor, Trans-acting factor, Nuclear protein, DNA-binding, Wnt signaling pathway, Alternative splicing, 3D-structure, Hypothetical protein | 1652 | 5620 |
| Contig58213_RC | PPARBP | PPAR binding protein | DNA-binding, Transcription regulation, Activator, Repeat, Nuclear protein, Alternative splicing | 1653 | 5621 |
| Contig58249_RC | moblak | MOB1, Mps One Binder kinase activator-like 2A (yeast) | Hypothetical protein | 1654 | 5622 |
| Contig58260_RC | DGAT2 | diacylglycerol O-acyltransferase homolog 2 (mouse) | Hypothetical protein, Acyltransferase, Transferase | 1655 | 5623 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig58275_RC | | general transcription factor IIIC, polypeptide 4, 90 kDa | | 1656 | 5624 |
| Contig58288_RC | LOC89941 | ras homolog gene family, member T2 | Hypothetical protein, GTP-binding | 1657 | 5625 |
| Contig58339_RC | FLJ21616 | MRNA; cDNA DKFZp686E1648 (from clone DKFZp686E1648) | Hypothetical protein | 1658 | 5626 |
| Contig58353_RC | FLJ13089 | hypothetical protein FLJ13089 | Hypothetical protein | 1659 | 5627 |
| Contig58491_RC | TRIP11 | ah24a06.s1 Soares_parathyroid_tumor_NbHPA *Homo sapiens* cDNA clone 1239730 3', mRNA sequence. | Hypothetical protein, Antigen, Golgi stack, Coiled coil, Chromosomal translocation | 1660 | 5628 |
| Contig58530_RC | KIAA1560 | glycerol 3-phosphate acyltransferase, mitochondrial | Hypothetical protein, Phospholipid biosynthesis, Transferase, Acyltransferase, Transmembrane, Mitochondrion, Transit peptide | 1661 | 5629 |
| Contig58595_RC | AP1M1 | adaptor-related protein complex 1, mu 1 subunit | Golgi stack, Protein transport, Transport, Coated pits, Endocytosis, Phosphorylation | 1662 | 5630 |
| Contig58613 | VPS4B | vacuolar protein sorting 4B (yeast) | ATP-binding | 1663 | 5631 |
| Contig58966_RC | HLA-F | major histocompatibility complex, class I, F | MHC | 1664 | 5632 |
| Contig59120_RC | FLJ37080 | adhesion molecule AMICA | Hypothetical protein | 1665 | 5633 |
| Contig59127_RC | PCF11 | pre-mRNA cleavage complex II protein Pcf11 | mRNA processing, Nuclear protein | 1666 | 5634 |
| Contig59134_RC | | hypothetical protein LOC283481 | | 1667 | 5635 |
| Contig59136_RC | | qp75d05.x1 Soares_fetal_lung_N bHL19W *Homo sapiens* cDNA clone IMAGE: 1928841 3' similar to gb: D14531 60S RIBOSOMAL PROTEIN L9 (HUMAN); mRNA sequence. | | 1668 | 5636 |
| Contig59187_RC | NUDT3 | nudix (nucleoside diphosphate linked moiety X)-type motif 3 | Hydrolase | 1669 | 5637 |
| Contig5954_RC | | similar to RIKEN cDNA B230118G17 gene | Hypothetical protein, Iron, Iron-sulfur | 1670 | 5638 |
| Contig60075 | FLJ32468 | ESTs | | 1671 | 5639 |
| Contig60315_RC | MGC39807 | organic solute transporter alpha | Hypothetical protein | 1672 | 5640 |
| Contig6041_RC | | Transcribed sequences | | 1673 | 5641 |
| Contig60509_RC | | GL004 protein | Hypothetical protein | 1674 | 5642 |
| Contig60612_RC | | xylosyltransferase I | Transferase, Glycosyltransferase | 1675 | 5643 |
| Contig6064_RC | | Colorectal cancer-related mRNA sequence | | 1676 | 5644 |
| Contig60981_RC | | p10-binding protein | Hypothetical protein | 1677 | 5645 |
| Contig61061_RC | RASGRP4 | RAS guanyl releasing protein 4 | Hypothetical protein | 1678 | 5646 |
| Contig6113_RC | | CDNA FLJ30090 fis, clone BNGH41000015 | | 1679 | 5647 |
| Contig61227_RC | | hypothetical protein FLJ10055 | Hypothetical protein, Repeat, WD repeat | 1680 | 5648 |
| Contig61254_RC | MGC5352 | hypothetical protein MGC5352 | Hypothetical protein | 1681 | 5649 |
| Contig61264_RC | KIAA1833 | hypothetical protein KIAA1833 | Hypothetical protein | 1682 | 5650 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig61267_RC | C20orf126 | chromosome 20 open reading frame 126 | Hypothetical protein | 1683 | 5651 |
| Contig61815 | LOC51063 | hypothetical protein LOC51063 | Hypothetical protein | 1684 | 5652 |
| Contig61848_RC | | Transcribed sequence with weak similarity to protein ref: NP_060312.1 (*H. sapiens*) hypothetical protein FLJ20489 [*Homo sapiens*] | | 1685 | 5653 |
| Contig61915_RC | MGC2803 | hypothetical protein MGC2803 | Hypothetical protein | 1686 | 5654 |
| Contig61975 | MGC11242 | hypothetical protein MGC11242 | Hypothetical protein | 1687 | 5655 |
| Contig62149_RC | | chromosome 22 open reading frame 23 | Hypothetical protein | 1688 | 5656 |
| Contig6254_RC | | Transcribed sequences | | 1689 | 5657 |
| Contig62568_RC | MRPL24 | mitochondrial ribosomal protein L24 | Ribosomal protein, Hypothetical protein | 1690 | 5658 |
| Contig62588_RC | | hypothetical protein LOC284323 | DNA-binding, Metal-binding, Nuclear protein, Zinc-finger | 1691 | 5659 |
| Contig62628_RC | EIF3S9 | eukaryotic translation initiation factor 3, subunit 9 eta, 116 kDa | Hypothetical protein, Initiation factor, Protein biosynthesis, RNA-binding | 1692 | 5660 |
| Contig62675_RC | | similar to RIKEN 1810056O20 | Hypothetical protein | 1693 | 5661 |
| Contig62923_RC | FLJ12697 | ubiquitin specific protease 42 | Ubl conjugation pathway, Hydrolase, Thiol protease, Multigene family | 1694 | 5662 |
| Contig63026 | | hypothetical protein LOC285958 | | 1695 | 5663 |
| Contig63079 | FLJ32332 | likely ortholog of mouse protein phosphatase 2C eta | Hypothetical protein | 1696 | 5664 |
| Contig6323_RC | FLJ12581 | Nanog homeobox | DNA-binding, Homeobox, Nuclear protein, Hypothetical protein | 1697 | 5665 |
| Contig63304 | LOC113444 | hypothetical protein BC011880 | Hypothetical protein | 1698 | 5666 |
| Contig63667_RC | MCPR | hypothetical protein LOC285069 | Ubl conjugation pathway, Cell cycle, Cell division, Mitosis, Repeat | 1699 | 5667 |
| Contig6382_RC | | Transcribed sequences | | 1700 | 5668 |
| Contig63913_RC | MGC13016 | coiled-coil-helix-coiled-coil-helix domain containing 6 | | 1701 | 5669 |
| Contig64214_RC | MGC19604 | similar to RIKEN cDNA B230118G17 gene | Hypothetical protein | 1702 | 5670 |
| Contig64297_RC | KIAA1416 | KIAA1416 protein | Hypothetical protein, Transcription regulation, Hydrolase, Helicase, Chromatin regulator, Nuclear protein, ATP-binding, DNA-binding, Repeat | 1703 | 5671 |
| Contig64390 | C20orf92 | COMM domain containing 7 | Hypothetical protein | 1704 | 5672 |
| Contig64477 | | Clone IMAGE: 5742072, mRNA | | 1705 | 5673 |
| Contig64502 | KIAA0303 | KIAA0303 protein | Hypothetical protein, ATP-binding, Kinase, Serine/threonine-protein kinase, Transferase | 1706 | 5674 |
| Contig64691 | UBB | ubiquitin B | Hypothetical protein | 1707 | 5675 |
| Contig64794 | FLJ21156 | *Homo sapiens* cDNA: FLJ21156 fis, clone CAS09878. | Hypothetical protein | 1708 | 5676 |
| Contig64940_RC | ORAOV1 | oral cancer overexpressed 1 | Hypothetical protein | 1709 | 5677 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig65300_RC | | CDNA FLJ41454 fis, clone BRSTN2011597 | | 1710 | 5678 |
| Contig65404 | CKLFSF3 | chemokine-like factor super family 3 | Chemotaxis, Cytokine, Transmembrane, Alternative splicing | 1711 | 5679 |
| Contig65439 | C20orf178 | chromosome 20 open reading frame 178 | Hypothetical protein | 1712 | 5680 |
| Contig65459_RC | | formin binding protein 1 | Hypothetical protein, SH3 domain | 1713 | 5681 |
| Contig65478_RC | | phosphoglucomutase 2-like 1 | Hypothetical protein | 1714 | 5682 |
| Contig65900 | HMGN3 | high mobility group nucleosomal binding domain 3 | Nuclear protein, DNA-binding, Hypothetical protein | 1715 | 5683 |
| Contig65934_RC | | hypothetical gene supported by BC031661 | Hypothetical protein | 1716 | 5684 |
| Contig66003_RC | MY038 | retinoblastoma binding protein 6 | Hypothetical protein, Metal-binding, Zinc, Zinc-finger | 1717 | 5685 |
| Contig66028_RC | | reversion-inducing-cysteine-rich protein with kazal motifs | Signal, Glycoprotein, GPI-anchor, Serine protease inhibitor, Membrane, Anti-oncogene, Repeat, Lipoprotein | 1718 | 5686 |
| Contig66129_RC | | CDNA FLJ13276 fis, clone OVARC1001040 | | 1719 | 5687 |
| Contig66573_RC | FLJ12567 | Clone IMAGE: 5538723, mRNA | Hypothetical protein | 1720 | 5688 |
| Contig66615_RC | USP9Y | Human S6 H-8 mRNA expressed in chromosome 6-suppressed melanoma cells. | Ubiquitin conjugation, Hydrolase, Thiol protease, Multigene family, Alternative splicing | 1721 | 5689 |
| Contig66632_RC | | hypothetical protein LOC339324 | | 1722 | 5690 |
| Contig66759_RC | MGC16028 | MGC16028 similar to RIKEN cDNA 1700019E19 gene | | 1723 | 5691 |
| Contig667_RC | ADAM17 | hypothetical protein LOC285148 | Hydrolase, Metalloprotease, Zinc, Signal, Glycoprotein, Zymogen, Transmembrane, SH3-binding, Phosphorylation, Alternative splicing, 3D-structure | 1724 | 5692 |
| Contig66868_RC | | ze63e05.s1 Soares retina N2b4HR *Homo sapiens* cDNA clone IMAGE: 363680 3', mRNA sequence. | | 1725 | 5693 |
| Contig66904_RC | MGC4368 | hypothetical protein MGC4368 | Hypothetical protein | 1726 | 5694 |
| Contig684_RC | RPS3A | ring finger protein 12 | Transcription regulation, Zinc-finger, Hypothetical protein, Metal-binding | 1727 | 5695 |
| Contig693_RC | NFIA | nuclear factor I/A | Activator, DNA replication, DNA-binding, Nuclear protein, Transcription, Transcription regulation, Multigene family | 1728 | 5696 |
| Contig706_RC | | CDNA FLJ32401 fis, clone SKMUS2000339 | | 1729 | 5697 |
| Contig726_RC | FLJ13725 | hypothetical protein FLJ13725 | Hypothetical protein | 1730 | 5698 |
| Contig732_RC | FTH1 | transducer of regulated cAMP response element-binding protein (CREB) 2 | Hypothetical protein | 1731 | 5699 |
| Contig7401_RC | FLJ22756 | PDZ domain containing 2 | Hypothetical protein | 1732 | 5700 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| Contig75_RC | RPS6KA2 | ribosomal protein S6 kinase, 90 kDa, polypeptide 2 | ATP-binding, Kinase, Serine/threonine-protein kinase, Transferase, Repeat, Multigene family, Phosphorylation, Nuclear protein | 1733 | 5701 |
| Contig773 | FLJ20989 | hypothetical protein FLJ20989 | Hypothetical protein | 1734 | 5702 |
| Contig8210_RC | DJ467N11.1 | dJ467N11.1 protein | ATP-binding, Helicase, Hydrolase, Hypothetical protein | 1735 | 5703 |
| Contig830_RC | C1orf13 | N-acetylneuraminate pyruvate lyase (dihydrodipicolinate synthase) | | 1736 | 5704 |
| Contig8371_RC | | Transcribed sequences | | 1737 | 5705 |
| Contig842_RC | | human T-cell leukemia virus enhancer factor | Transcription regulation, DNA-binding, Nuclear protein | 1738 | 5706 |
| Contig844_RC | DKFZP566M1046 | hypothetical protein DKFZp566M1046 | Hypothetical protein | 1739 | 5707 |
| Contig8547_RC | | Transcribed sequences | | 1740 | 5708 |
| Contig883_RC | KIAA1813 | KIAA1813 protein | Hypothetical protein | 1741 | 5709 |
| Contig8885_RC | HCS | cytochrome c, somatic | Mitochondrion, Electron transport, Respiratory chain, Heme, Acetylation, Polymorphism, Apoptosis | 1742 | 5710 |
| Contig8909_RC | MGC45404 | TAK1-binding protein 3 | Hypothetical protein | 1743 | 5711 |
| Contig8956_RC | FLJ13158 | chromosome 6 open reading frame 134 | Hypothetical protein | 1744 | 5712 |
| Contig8963_RC | | wi72b03.x1 NCI_CGAP_Kid12 *Homo sapiens* cDNA clone IMAGE: 2398829 3', mRNA sequence. | | 1745 | 5713 |
| Contig8980_RC | DKFZP564B1162 | hypothetical protein DKFZp564B1162 | Hypothetical protein | 1746 | 5714 |
| Contig9042_RC | | Transcribed sequences | | 1747 | 5715 |
| Contig9059_RC | FLJ12118 | hypothetical protein FLJ12118 | Hypothetical protein | 1748 | 5716 |
| Contig9136_RC | | CDNA FLJ43053 fis, clone BRTHA3006856 | | 1749 | 5717 |
| Contig9380_RC | | Transcribed sequences | | 1750 | 5718 |
| Contig9514_RC | | Transcribed sequences | | 1751 | 5719 |
| Contig9518_RC | ZNF287 | zinc finger protein 287 | Metal-binding, Zinc, Zinc-finger, Transcription regulation, Nuclear protein, DNA-binding, Repeat | 1752 | 5720 |
| Contig964_RC | MGC10433 | hypothetical protein MGC10433 | Hypothetical protein | 1753 | 5721 |
| Contig9714_RC | | MRNA for hypothetical protein (ORF1), clone 00275 | Hypothetical protein | 1754 | 5722 |
| Contig973_RC | MRPL45 | mitochondrial ribosomal protein L45 | Ribosomal protein, Mitochondrion, Transit peptide | 1755 | 5723 |
| Contig9810_RC | KCNE1 | potassium voltage-gated channel, lsk-related family, member 1 | Transport, Ion transport, Ionic channel, Voltage-gated channel, Potassium channel, Potassium, Potassium transport, Transmembrane, Phosphorylation, Glycoprotein, Polymorphism, Disease mutation, Long QT syndrome, Deafness | 1756 | 5724 |
| Contig9965_RC | DHODH | dihydroorotate dehydrogenase | Pyrimidine biosynthesis, Oxidoreductase, Flavoprotein, FAD, Transit peptide, Mitochondrion, 3D-structure | 1757 | 5725 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| D10040 | FACL2 | acyl-CoA synthetase long-chain family member 1 | Ligase, Fatty acid metabolism, Magnesium, Multigene family, Hypothetical protein | 1758 | 5726 |
| D13642 | SF3B3 | splicing factor 3b, subunit 3, 130 kDa | Spliceosome, mRNA processing, mRNA splicing, Nuclear protein, Hypothetical protein | 1759 | 5727 |
| D16816 | REG1B | regenerating islet-derived 1 beta (pancreatic stone protein, pancreatic thread protein) | Glycoprotein, Signal, Lectin, Pyrrolidone carboxylic acid | 1760 | 5728 |
| D21064 | INPP5E | peptidase (mitochondrial processing) alpha | Hypothetical protein, Hydrolase, Metalloprotease, Mitochondrion, Transit peptide | 1761 | 5729 |
| D25218 | RRS1 | RRS1 ribosome biogenesis regulator homolog (*S. cerevisiae*) | Ribosome biogenesis, Nuclear protein | 1762 | 5730 |
| D25328 | PFKP | phosphofructokinase, platelet | Kinase, Transferase, Glycolysis, Repeat, Allosteric enzyme, Phosphorylation, Magnesium, Multigene family | 1763 | 5731 |
| D26070 | ITPR1 | inositol 1,4,5-triphosphate receptor, type 1 | Receptor, Transmembrane, Phosphorylation, Endoplasmic reticulum, Ionic channel, Ion transport, Calcium channel, Alternative splicing, Repeat | 1764 | 5732 |
| D26362 | BRD3 | bromodomain containing 3 | Bromodomain, Repeat, Nuclear protein | 1765 | 5733 |
| D26488 | KIAA0007 | KIAA0007 protein | Hypothetical protein, Repeat, WD repeat | 1766 | 5734 |
| D29954 | KIAA0056 | KIAA0056 protein | Hypothetical protein | 1767 | 5735 |
| D29958 | KIAA0116 | KIAA0116 protein | Exosome, Hydrolase, Nuclease, Exonuclease, rRNA processing, Nuclear protein, RNA-binding, Polymorphism, Hypothetical protein | 1768 | 5736 |
| D31886 | RAB3GAP | RAB3 GTPase-ACTIVATING PROTEIN | Hypothetical protein | 1769 | 5737 |
| D31887 | KIAA0062 | solute carrier family 39 (zinc transporter), member 14 | Hypothetical protein | 1770 | 5738 |
| D38435 | PMS2L1 | postmeiotic segregation increased 2-like 6 | Hypothetical protein, DNA repair, Anti-oncogene, Nuclear protein, Polymorphism, Disease mutation, Hereditary nonpolyposis colorectal cancer, 3D-structure | 1771 | 5739 |
| D38522 | SYT11 | *Homo sapiens* KIAA0080 mRNA, partial cds. | Transmembrane, Repeat, Synapse, Hypothetical protein | 1772 | 5740 |
| D38549 | CYFIP1 | cytoplasmic FMR1 interacting protein 1 | Hypothetical protein | 1773 | 5741 |
| D42043 | KIAA0084 | raft-linking protein | Hypothetical protein | 1774 | 5742 |
| D42084 | METAP1 | methionyl aminopeptidase 1 | Hydrolase, Aminopeptidase, Cobalt | 1775 | 5743 |
| D43948 | KIAA0097 | KIAA0097 gene product | Hypothetical protein, Repeat | 1776 | 5744 |
| D43949 | KIAA0082 | KIAA0082 | Hypothetical protein | 1777 | 5745 |
| D50402 | SLC11A1 | solute carrier family 11 (proton-coupled divalent metal ion transporters), member 1 | Transport, Iron transport, Transmembrane, Glycoprotein, Macrophage, Polymorphism | 1778 | 5746 |
| D50911 | GSA7 | KIAA0121 gene product | Hypothetical protein | 1779 | 5747 |
| D50918 | 6-Sep | septin 6 | Cell division, GTP-binding, Coiled coil, Alternative splicing | 1780 | 5748 |
| D63487 | KIAA0153 | KIAA0153 protein | Hypothetical protein | 1781 | 5749 |
| D79998 | KCTD2 | potassium channel tetramerisation domain containing 2 | Hypothetical protein | 1782 | 5750 |
| D80007 | PDCD11 | programmed cell death 11 | Nuclear protein, rRNA processing, Repeat, Polymorphism | 1783 | 5751 |
| D80010 | LPIN1 | lipin 1 | Nuclear protein, Polymorphism | 1784 | 5752 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| D83781 | NUP160 | nucleoporin 160 kDa | Nuclear protein, Transport, Alternative splicing, Hypothetical protein | 1785 | 5753 |
| D84294 | TTC3 | tetratricopeptide repeat domain 3 | Repeat, TPR repeat, Zinc-finger, Alternative splicing, Polymorphism, Metal-binding | 1786 | 5754 |
| D86964 | DOCK2 | dedicator of cytokinesis 2 | Guanine-nucleotide releasing factor, Membrane, Cytoskeleton, SH3 domain, Alternative splicing, Polymorphism | 1787 | 5755 |
| D86973 | GCN1L1 | GCN1 general control of amino-acid synthesis 1-like 1 (yeast) | Hypothetical protein | 1788 | 5756 |
| D86976 | HA-1 | minor histocompatibility antigen HA-1 | | 1789 | 5757 |
| D87442 | NCSTN | nicastrin | Transmembrane, Glycoprotein, Signal, Alternative splicing | 1790 | 5758 |
| D87449 | SLC35D1 | solute carrier family 35 (UDP-glucuronic acid/UDP-N-acetylgalactosamine dual transporter), member D1 | Transport, Sugar transport, Transmembrane, Endoplasmic reticulum | 1791 | 5759 |
| D87453 | MRPS27 | mitochondrial ribosomal protein S27 | Hypothetical protein, Ribosomal protein, Mitochondrion | 1792 | 5760 |
| D87466 | KIAA0276 | KIAA0276 protein | Hypothetical protein | 1793 | 5761 |
| G26403 | C9orf19 | chromosome 9 open reading frame 19 | Hypothetical protein | 1794 | 5762 |
| J03077 | PSAP | prosaposin (variant Gaucher disease and variant metachromatic leukodystrophy) | Signal, Glycoprotein, Lysosome, Sphingolipid metabolism, Repeat, Gaucher disease, GM2-gangliosidosis, Disease mutation, Metachromatic leukodystrophy, Alternative splicing, 3D-structure | 1795 | 5763 |
| J03796 | EPB41 | erythrocyte membrane protein band 4.1 (elliptocytosis 1, RH-linked) | Structural protein, Alternative splicing, Cytoskeleton, Actin-binding, Phosphorylation, Pyropoikilocytosis, Glycoprotein, Elliptocytosis, Hereditary hemolytic anemia, Polymorphism, 3D-structure | 1796 | 5764 |
| J04162 | FCGR3A | Fc fragment of IgG, low affinity IIIa, receptor for (CD16) | Receptor, IgG-binding protein, Transmembrane, Glycoprotein, Signal, Immunoglobulin domain, Repeat, Multigene family, Polymorphism, GPI-anchor, 3D-structure, Lipoprotein | 1797 | 5765 |
| J04178 | HEXA | hexosaminidase A (alpha polypeptide) | Hydrolase, Glycosidase, Lysosome, GM2-gangliosidosis, Signal, Zymogen, Glycoprotein, Disease mutation, Polymorphism, 3D-structure | 1798 | 5766 |
| K02276 | MYC | v-myc myelocytomatosis viral oncogene homolog (avian) | Proto-oncogene, Nuclear protein, DNA-binding, Phosphorylation, Transcription regulation, Activator, Glycoprotein, Polymorphism, 3D-structure. | 1799 | 5767 |
| K02403 | C4A | complement component 4A | Complement pathway, Plasma, Glycoprotein, Sulfation, Signal, Inflammatory response, Polymorphism, Disease mutation, Blood group antigen, Thioester bond | 1800 | 5768 |
| L00635 | FNTB | farnesyltransferase, CAAX box, beta | Plasmid, Transferase, Prenyltransferase, Repeat, Zinc | 1801 | 5769 |
| L08246 | MCL1 | myeloid cell leukemia sequence 1 (BCL2-related) | Apoptosis, Transmembrane, Differentiation, Alternative splicing | 1802 | 5770 |
| L20688 | ARHGDIB | Rho GDP dissociation inhibitor (GDI) beta | GTPase activation, 3D-structure | 1803 | 5771 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| L21961 | IGL@ | Human Ig rearranged lambda-chain mRNA, subgroup VL3, V-J region, partial cds. | Immunoglobulin domain, Hypothetical protein, Immunoglobulin C region, 3D-structure | 1804 | 5772 |
| L22005 | CDC34 | cell division cycle 34 | Ubl conjugation pathway, Ligase, Multigene family, Hypothetical protein, Cell division | 1805 | 5773 |
| L27943 | CDA | cytidine deaminase | Hydrolase, Zinc | 1806 | 5774 |
| L35035 | RPIA | ribose 5-phosphate isomerase A (ribose 5-phosphate epimerase) | Isomerase | 1807 | 5775 |
| L39061 | TAF1B | TATA box binding protein (TBP)-associated factor, RNA polymerase I, B, 63 kDa | Hypothetical protein | 1808 | 5776 |
| L40027 | GSK3A | glycogen synthase kinase 3 alpha | Transferase, Serine/threonine-protein kinase, ATP-binding, Multigene family, Phosphorylation | 1809 | 5777 |
| M12679 | HLA-C | major histocompatibility complex, class I, C | Glycoprotein, Signal, Transmembrane, Hypothetical protein, MHC, MHC I, Polymorphism, 3D-structure, Alternative splicing | 1810 | 5778 |
| M12758 | HLA-C | Human MHC class I HLA-A cell surface antigen mRNA, (HLA-A2, -B7, -C), clone JY103. | Glycoprotein, Transmembrane | 1811 | 5779 |
| M17733 | TMSB4X | thymosin, beta 4, X-linked | Actin-binding, Cytoskeleton, Acetylation | 1812 | 5780 |
| M26383 | IL8 | interleukin 8 | Cytokine, Chemotaxis, Inflammatory response, Signal, Alternative splicing, 3D-structure | 1813 | 5781 |
| M31212 | MYL6 | myosin, light polypeptide 6, alkali, smooth muscle and non-muscle | Myosin, Muscle protein, Acetylation, Alternative splicing, Multigene family | 1814 | 5782 |
| M31523 | TCF3 | transcription factor 3 (E2A immunoglobulin enhancer binding factors E12/E47) | Transcription regulation, DNA-binding, Nuclear protein, Proto-oncogene, Chromosomal translocation, Alternative splicing, Phosphorylation, 3D-structure | 1815 | 5783 |
| M33552 | LSP1 | lymphocyte-specific protein 1 | T-cell, Phosphorylation, Polymorphism | 1816 | 5784 |
| M34671 | CD59 | CD59 antigen p18-20 (antigen identified by monoclonal antibodies 16.3A5, EJ16, EJ30, EL32 and G344) | Antigen, Glycoprotein, GPI-anchor, Signal, 3D-structure, Lipoprotein | 1817 | 5785 |
| M37712 | CDC2L2 | Homo sapiens p58/GTA protein kinase mRNA, complete cds. | Apoptosis, Transferase, Serine/threonine-protein kinase, ATP-binding, Cell cycle, Phosphorylation, Alternative splicing, Alternative initiation | 1818 | 5786 |
| M60721 | HLX1 | H2.0-like homeo box 1 (Drosophila) | DNA-binding, Homeobox, Nuclear protein, Transcription regulation | 1819 | 5787 |
| M63438 | IGKC | Immunoglobulin kappa light chain mRNA, partial cds | Hypothetical protein | 1820 | 5788 |
| M65292 | HFL1 | H factor (complement)-like 1 | Repeat, Glycoprotein, Sushi, Signal, Polymorphism | 1821 | 5789 |
| M74782 | IL3RA | interleukin 3 receptor, alpha (low affinity) | Receptor, Transmembrane, Glycoprotein, Signal | 1822 | 5790 |
| M83822 | LRBA | LPS-responsive vesicle trafficking, beach and anchor containing | Repeat, WD repeat | 1823 | 5791 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| M90657 | TM4SF1 | Human tumor antigen (L6) mRNA, complete cds. | Glycoprotein, Antigen, Transmembrane | 1824 | 5792 |
| M91211 | AGER | advanced glycosylation end product-specific receptor | Immunoglobulin domain, Glycoprotein, Transmembrane, Repeat, Signal, Alternative splicing, Polymorphism, Receptor | 1825 | 5793 |
| M92439 | LRPPRC | leucine-rich PPR-motif containing | Hypothetical protein, Repeat | 1826 | 5794 |
| M92642 | COL16A1 | collagen, type XVI, alpha 1 | Extracellular matrix, Connective tissue, Collagen, Hydroxylation, Repeat, Signal | 1827 | 5795 |
| M94362 | LMNB2 | Human lamin B2 (LAMB2) mRNA, partial cds. | Intermediate filament, Coiled coil, Nuclear protein, Lipoprotein, Prenylation, Phosphorylation, Hypothetical protein | 1828 | 5796 |
| NM_000016 | ACADM | acyl-Coenzyme A dehydrogenase, C-4 to C-12 straight chain | Oxidoreductase, Flavoprotein, FAD, Fatty acid metabolism, Mitochondrion, Transit peptide, Disease mutation, 3D-structure | 1829 | 5797 |
| NM_000018 | ACADVL | acyl-Coenzyme A dehydrogenase, very long chain | Oxidoreductase, Flavoprotein, FAD, Fatty acid metabolism, Mitochondrion, Transit peptide, Alternative splicing, Disease mutation, Polymorphism, Cardiomyopathy | 1830 | 5798 |
| NM_000021 | PSEN1 | presenilin 1 (Alzheimer disease 3) | Transmembrane, Phosphorylation, Endoplasmic reticulum, Golgi stack, Alzheimer's disease, Disease mutation, Polymorphism, Alternative splicing | 1831 | 5799 |
| NM_000022 | ADA | adenosine deaminase | Hydrolase, Nucleotide metabolism, SCID, Hereditary hemolytic anemia, Disease mutation, Polymorphism | 1832 | 5800 |
| NM_000026 | ADSL | adenylosuccinate lyase | Purine biosynthesis, Lyase, Alternative splicing, Disease mutation, Epilepsy | 1833 | 5801 |
| NM_000030 | AGXT | alanine-glyoxylate aminotransferase (oxalosis I; hyperoxaluria I; glycolicaciduria; serine-pyruvate aminotransferase) | Aminotransferase, Transferase, Pyridoxal phosphate, Peroxisome, Mitochondrion, Disease mutation, Polymorphism | 1834 | 5802 |
| NM_000034 | ALDOA | aldolase A, fructose-bisphosphate | Lyase, Schiff base, Glycolysis, Multigene family, 3D-structure, Disease mutation | 1835 | 5803 |
| NM_000045 | ARG1 | arginase, liver | Urea cycle, Arginine metabolism, Hydrolase, Manganese, Disease mutation, Polymorphism | 1836 | 5804 |
| NM_000056 | BCKDHB | branched chain keto acid dehydrogenase E1, beta polypeptide (maple syrup urine disease) | Oxidoreductase, Mitochondrion, Transit peptide, Disease mutation, Maple syrup urine disease, 3D-structure | 1837 | 5805 |
| NM_000070 | CAPN3 | calpain 3, (p94) | Hydrolase, Thiol protease, Calcium-binding, Multigene family, Repeat, Disease mutation, Polymorphism, Alternative splicing | 1838 | 5806 |
| NM_000073 | CD3G | CD3G antigen, gamma polypeptide (TiT3 complex) | Immunoglobulin domain, T-cell, Receptor, Transmembrane, Glycoprotein, Signal | 1839 | 5807 |
| NM_000074 | TNFSF5 | tumor necrosis factor (ligand) superfamily, member 5 (hyper-IgM syndrome) | Cytokine, Transmembrane, Glycoprotein, Signal-anchor, Antigen, Disease mutation, Polymorphism, 3D-structure | 1840 | 5808 |
| NM_000081 | CHS1 | Chediak-Higashi syndrome 1 | Protein transport, Transport, Repeat, WD repeat, Disease mutation, Alternative splicing | 1841 | 5809 |
| NM_000082 | CKN1 | Cockayne syndrome 1 (classical) | Nuclear protein, Repeat, WD repeat, Transcription regulation, Polymorphism, Cockayne's syndrome, Deafness, Dwarfism | 1842 | 5810 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000095 | COMP | cartilage oligomeric matrix protein (pseudoachondroplasia, epiphyseal dysplasia 1, multiple) | Hypothetical protein, Glycoprotein, Cell adhesion, Calcium-binding, Repeat, EGE-like domain, Signal, Disease mutation, Polymorphism | 1843 | 5811 |
| NM_000099 | CST3 | cystatin C (amyloid angiopathy and cerebral hemorrhage) | Thiol protease inhibitor, Amyloid, Signal, Disease mutation, Polymorphism, 3D-structure | 1844 | 5812 |
| NM_000100 | CSTB | cystatin B (stefin B) | Thiol protease inhibitor, Nuclear protein, Acetylation, Disease mutation, Epilepsy, 3D-structure | 1845 | 5813 |
| NM_000101 | CYBA | cytochrome b-245, alpha polypeptide | Oxidoreductase, NADP, Electron transport, Membrane, Heme, Polymorphism, Disease mutation, Chronic granulomatous disease, Hypothetical protein | 1846 | 5814 |
| NM_000116 | TAZ | tafazzin (cardiomyopathy, dilated 3A (X-linked); endocardial fibroelastosis 2; Barth syndrome) | Alternative splicing, Transmembrane, Disease mutation | 1847 | 5815 |
| NM_000120 | EPHX1 | epoxide hydrolase 1, microsomal (xenobiotic) | Hydrolase, Endoplasmic reticulum, Detoxification, Transmembrane, Aromatic hydrocarbons catabolism, Microsome, Polymorphism | 1848 | 5816 |
| NM_000121 | EPOR | erythropoietin receptor | Receptor, Transmembrane, Glycoprotein, Signal, Phosphorylation, 3D-structure | 1849 | 5817 |
| NM_000126 | ETFA | electron-transfer-flavoprotein, alpha polypeptide (glutaric aciduria II) | Electron transport, Flavoprotein, FAD, Mitochondrion, Transit peptide, Disease mutation, Glutaricaciduria, Polymorphism, 3D-structure | 1850 | 5818 |
| NM_000130 | F5 | coagulation factor V (proaccelerin, labile factor) | Blood coagulation, Glycoprotein, Sulfation, Calcium, Signal, Zymogen, Repeat, Polymorphism, Disease mutation, Thrombophilia, 3D-structure | 1851 | 5819 |
| NM_000143 | FH | fumarate hydratase | Lyase, Tricarboxylic acid cycle, Mitochondrion, Transit peptide, Acetylation, Alternative initiation, Anti-oncogene, Disease mutation | 1852 | 5820 |
| NM_000146 | FTL | ferritin, light polypeptide | Hypothetical protein, Iron storage, Metal-binding, Acetylation | 1853 | 5821 |
| NM_000151 | G6PC | glucose-6-phosphatase, catalytic (glycogen storage disease type I, von Gierke disease) | Glycogen biosynthesis, Hydrolase, Transmembrane, Glycoprotein, Endoplasmic reticulum, Glycogen storage disease, Disease mutation, Polymorphism | 1854 | 5822 |
| NM_000156 | GAMT | guanidinoacetate N-methyltransferase | Transferase, Methyltransferase | 1855 | 5823 |
| NM_000157 | GBA | glucosidase, beta; acid (includes glucosylceramidase) | Glycosidase, Hydrolase, Signal, Hypothetical protein, Sphingolipid metabolism, Glycoprotein, Lysosome, Membrane, Gaucher disease, Disease mutation, Polymorphism, Alternative initiation, Pharmaceutical | 1856 | 5824 |
| NM_000175 | GPI | glucose phosphate isomerase | Gluconeogenesis, Glycolysis, Isomerase, Growth factor, Cytokine, Disease mutation, 3D-structure, Hypothetical protein | 1857 | 5825 |
| NM_000177 | GSN | gelsolin (amyloidosis, Finnish type) | Cytoskeleton, Actin-binding, Repeat, Calcium, Alternative initiation, Signal, Amyloid, Disease mutation, 3D-structure, Phosphorylation, Actin capping | 1858 | 5826 |
| NM_000181 | GUSB | glucuronidase, beta | Hydrolase, Glycosidase, Lysosome, Glycoprotein, Signal, Mucopolysaccharidosis, Disease mutation, 3D-structure, Alternative splicing, Polymorphism | 1859 | 5827 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000183 | HADHB | hydroxyacyl-Coenzyme A dehydrogenase/3-ketoacyl-Coenzyme A thiolase/enoyl-Coenzyme A hydratase (trifunctional protein), beta subunit | Fatty acid metabolism, Transferase, Acyltransferase, Mitochondrion, Transit peptide, Disease mutation, Hypothetical protein | 1860 | 5828 |
| NM_000186 | HF1 | H factor 1 (complement) | Complement alternate pathway, Plasma, Glycoprotein, Repeat, Sushi, Signal, 3D-structure, Polymorphism, Alternative splicing | 1861 | 5829 |
| NM_000206 | IL2RG | interleukin 2 receptor, gamma (severe combined immunodeficiency) | Receptor, Transmembrane, Glycoprotein, Signal, Disease mutation, SCID, 3D-structure | 1862 | 5830 |
| NM_000211 | ITGB2 | integrin, beta 2 (antigen CD18 (p95), lymphocyte function-associated antigen 1; macrophage antigen 1 (mac-1) beta subunit) | Integrin, Cell adhesion, Receptor, Transmembrane, Glycoprotein, Repeat, Signal, Disease mutation, Pyrrolidone carboxylic acid, 3D-structure | 1863 | 5831 |
| NM_000229 | LCAT | lecithin-cholesterol acyltransferase | Cholesterol metabolism, Lipid metabolism, Transferase, Acyltransferase, Signal, Glycoprotein, Polymorphism, Disease mutation | 1864 | 5832 |
| NM_000235 | LIPA | lipase A, lysosomal acid, cholesterol esterase (Wolman disease) | Hydrolase, Lipid degradation, Glycoprotein, Signal, Lysosome, Disease mutation, Polymorphism | 1865 | 5833 |
| NM_000239 | LYZ | lysozyme (renal amyloidosis) | Hydrolase, Glycosidase, Bacteriolytic enzyme, Signal, Amyloid, 3D-structure, Disease mutation, Polymorphism | 1866 | 5834 |
| NM_000243 | MEFV | Mediterranean fever | Inflammatory response, Actin-binding, Metal-binding, Cytoskeleton, Microtubule, Nuclear protein, Zinc-finger, Zinc, Polymorphism, Disease mutation, Alternative splicing | 1867 | 5835 |
| NM_000249 | MLH1 | mutL homolog 1, colon cancer, nonpolyposis type 2 (E. coli) | DNA repair, Nuclear protein, Disease mutation, Anti-oncogene, Polymorphism, Hereditary nonpolyposis colorectal cancer | 1868 | 5836 |
| NM_000250 | MPO | myeloperoxidase | Oxidoreductase, Peroxidase, Iron, Heme, Calcium-binding, Glycoprotein, Signal, Oxidation, Lysosome, Alternative splicing, Polymorphism, Disease mutation, 3D-structure | 1869 | 5837 |
| NM_000254 | MTR | 5-methyltetrahydrofolate-homocysteine methyltransferase | Transferase, Methyltransferase, Methionine biosynthesis, Vitamin B12, Cobalt, Disease mutation, Polymorphism | 1870 | 5838 |
| NM_000265 | NCF1 | neutrophil cytosolic factor 1 (47 kDa, chronic granulomatous disease, autosomal 1) | SH3 domain, Repeat, Polymorphism, Disease mutation, Chronic granulomatous disease, 3D-structure | 1871 | 5839 |
| NM_000269 | NME1 | non-metastatic cells 1, protein (NM23A) expressed in | Transferase, Kinase, ATP-binding, Nuclear protein, Anti-oncogene, Disease mutation, 3D-structure | 1872 | 5840 |
| NM_000270 | NP | nucleoside phosphorylase | Hypothetical protein, Transferase, Glycosyltransferase, Polymorphism, Disease mutation, 3D-structure | 1873 | 5841 |
| NM_000285 | PEPD | peptidase D | Collagen degradation, Hydrolase, Dipeptidase, Metalloprotease, Manganese, Acetylation, Polymorphism, Disease mutation | 1874 | 5842 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000288 | PEX7 | peroxisomal biogenesis factor 7 | Repeat, WD repeat, Peroxisome, Transport, Protein transport, Rhizomelic chondrodysplasia punctata, Disease mutation, Polymorphism | 1875 | 5843 |
| NM_000289 | PFKM | phosphofructokinase, muscle | Glycolysis, Kinase, Transferase, Repeat, Allosteric enzyme, Phosphorylation, Magnesium, Multigene family, Alternative splicing, Disease mutation, Glycogen storage disease | 1876 | 5844 |
| NM_000291 | PGK1 | phosphoglycerate kinase 1 | Transferase, Kinase, Multigene family, Glycolysis, Acetylation, Disease mutation, Polymorphism, Hereditary hemolytic anemia | 1877 | 5845 |
| NM_000295 | SERPINA1 | serine (or cysteine) proteinase inhibitor, clade A (alpha-1 antiproteinase, antitrypsin), member 1 | Serpin, Serine protease inhibitor, Glycoprotein, Plasma, Polymorphism, Acute phase, Signal, 3D-structure, Disease mutation, Protease inhibitor | 1878 | 5846 |
| NM_000297 | PKD2 | polycystic kidney disease 2 (autosomal dominant) | Ionic channel, Glycoprotein, Coiled coil, Transmembrane, Calcium-binding, Disease mutation, Polymorphism | 1879 | 5847 |
| NM_000302 | PLOD | procollagen-lysine, 2-oxoglutarate 5-dioxygenase (lysine hydroxylase, Ehlers-Danlos syndrome type VI) | Oxidoreductase, Dioxygenase, Signal, Iron, Vitamin C, Glycoprotein, Endoplasmic reticulum, Membrane, Polymorphism, Disease mutation, Ehlers-Danlos syndrome | 1880 | 5848 |
| NM_000305 | PON2 | paraoxonase 2 | Hydrolase, Glycoprotein, Signal, Membrane, Multigene family, Polymorphism, Alternative splicing | 1881 | 5849 |
| NM_000307 | POU3F4 | POU domain, class 3, transcription factor 4 | Transcription regulation, Nuclear protein, DNA-binding, Homeobox, Disease mutation, Deafness | 1882 | 5850 |
| NM_000320 | QDPR | quinoid dihydropteridine reductase | Tetrahydrobiopterin biosynthesis, Oxidoreductase, NADP, 3D-structure, Polymorphism, Phenylketonuria, Disease mutation | 1883 | 5851 |
| NM_000321 | RB1 | retinoblastoma 1 (including osteosarcoma) | Transcription regulation, DNA-binding, Nuclear protein, Phosphorylation, Anti-oncogene, Disease mutation, 3D-structure | 1884 | 5852 |
| NM_000327 | ROM1 | retinal outer segment membrane protein 1 | Vision, Cell adhesion, Photoreceptor, Transmembrane, Polymorphism, Disease mutation, Retinitis pigmentosa | 1885 | 5853 |
| NM_000376 | VDR | vitamin D (1,25-dihydroxyvitamin D3) receptor | Receptor, Transcription regulation, DNA-binding, Nuclear protein, Zinc-finger, Phosphorylation, Disease mutation, 3D-structure | 1886 | 5854 |
| NM_000377 | WAS | Wiskott-Aldrich syndrome (eczema-thrombocytopenia) | Repeat, Disease mutation, Phosphorylation, 3D-structure | 1887 | 5855 |
| NM_000380 | XPA | xeroderma pigmentosum, complementation group A | DNA repair, DNA-binding, Zinc-finger, Nuclear protein, Xeroderma pigmentosum, Disease mutation, Polymorphism, 3D-structure | 1888 | 5856 |
| NM_000386 | BLMH | bleomycin hydrolase | Hydrolase, Thiol protease, Polymorphism, 3D-structure, Hypothetical protein | 1889 | 5857 |
| NM_000392 | ABCC2 | ATP-binding cassette, sub-family C (CFTR/MRP), member 2 | ATP-binding, Glycoprotein, Transmembrane, Transport, Repeat, Disease mutation, Polymorphism | 1890 | 5858 |
| NM_000394 | CRYAA | crystallin, alpha A | Eye lens protein, Acetylation, Glycoprotein, Disease mutation, Vision | 1891 | 5859 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000397 | CYBB | cytochrome b-245, beta polypeptide (chronic granulomatous disease) | Oxidoreductase, NADP, Electron transport, Transmembrane, FAD, Heme, Glycoprotein, Voltage-gated channel, Ionic channel, Disease mutation, Chronic granulomatous disease | 1892 | 5860 |
| NM_000399 | EGR2 | early growth response 2 (Krox-20 homolog, *Drosophila*) | Transcription regulation, Activator, DNA-binding, Nuclear protein, Repeat, Zinc-finger, Metal-binding, Alternative splicing, Disease mutation, Charcot-Marie-Tooth disease, Dejerine-Sottas syndrome | 1893 | 5861 |
| NM_000401 | EXT2 | exostoses (multiple) 2 | Transferase, Glycosyltransferase, Endoplasmic reticulum, Golgi stack, Transmembrane, Signal-anchor, Glycoprotein, Anti-oncogene, Disease mutation, Hereditary multiple exostoses, Alternative splicing | 1894 | 5862 |
| NM_000402 | G6PD | glucose-6-phosphate dehydrogenase | Oxidoreductase, NADP, Glucose metabolism, Disease mutation, Polymorphism, Hereditary hemolytic anemia, Alternative splicing, Acetylation | 1895 | 5863 |
| NM_000404 | GLB1 | galactosidase, beta 1 | Hydrolase, Glycosidase, Lysosome, Signal, Alternative splicing, Glycoprotein, Polymorphism, Disease mutation | 1896 | 5864 |
| NM_000405 | GM2A | GM2 ganglioside activator protein | Signal, Glycoprotein, Lysosome, Sphingolipid metabolism, GM2-gangliosidosis, Disease mutation, Polymorphism, 3D-structure | 1897 | 5865 |
| NM_000407 | GP1BB | glycoprotein lb (platelet), beta polypeptide | Hypothetical protein, Cell division, GTP-binding, Coiled coil, Platelet, Transmembrane, Glycoprotein, Hemostasis, Blood coagulation, Signal, Phosphorylation, Cell adhesion, Leucine-rich repeat | 1898 | 5866 |
| NM_000418 | IL4R | interleukin 4 receptor | Receptor, Transmembrane, Glycoprotein, Signal, Disease mutation, Polymorphism, 3D-structure | 1899 | 5867 |
| NM_000425 | L1CAM | L1 cell adhesion molecule (hydrocephalus, stenosis of aqueduct of Sylvius 1, MASA (mental retardation, aphasia, shuffling gait and adducted thumbs) syndrome, spastic paraplegia 1) | Neurogenesis, Cell adhesion, Developmental protein, Glycoprotein, Transmembrane, Repeat, Antigen, Immunoglobulin domain, Signal, Disease mutation, Alternative splicing | 1900 | 5868 |
| NM_000433 | NCF2 | neutrophil cytosolic factor 2 (65 kDa, chronic granulomatous disease, autosomal 2) | SH3 domain, Repeat, TPR repeat, Chronic granulomatous disease, Disease mutation, 3D-structure | 1901 | 5869 |
| NM_000434 | NEU1 | sialidase 1 (lysosomal sialidase) | Hydrolase, Glycosidase, Signal, Repeat, Glycoprotein, Disease mutation, Polymorphism, Phosphorylation | 1902 | 5870 |
| NM_000436 | OXCT | 3-oxoacid CoA transferase | Mitochondrion, Transferase, Transit peptide, Disease mutation, Polymorphism | 1903 | 5871 |
| NM_000445 | PLEC1 | plectin 1, intermediate filament binding protein 500 kDa | Coiled coil, Repeat, Structural protein, Cytoskeleton, Actin-binding, Phosphorylation, Alternative splicing, Epidermolysis bullosa, Disease mutation | 1904 | 5872 |
| NM_000454 | SOD1 | superoxide dismutase 1, soluble (amyotrophic lateral sclerosis 1 (adult)) | Antioxidant, Oxidoreductase, Metal-binding, Copper, Zinc, Acetylation, 3D-structure, Amyotrophic lateral sclerosis, Disease mutation | 1905 | 5873 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000456 | SUOX | sulfite oxidase | Oxidoreductase, Mitochondrion, Heme, Molybdenum, Transit peptide, Disease mutation, 3D-structure | 1906 | 5874 |
| NM_000462 | UBE3A | ubiquitin protein ligase E3A (human papilloma virus E6-associated protein, Angelman syndrome) | Ligase, Nuclear protein, Ubl conjugation pathway, Alternative splicing, Disease mutation, Polymorphism, 3D-structure, Hypothetical protein | 1907 | 5875 |
| NM_000476 | AK1 | adenylate kinase 1 | Transferase, Kinase, ATP-binding, Acetylation, Disease mutation | 1908 | 5876 |
| NM_000480 | AMPD3 | adenosine monophosphate deaminase (isoform E) | Hydrolase, Nucleotide metabolism, Multigene family, Polymorphism, Alternative splicing | 1909 | 5877 |
| NM_000481 | AMT | aminomethyltransferase (glycine cleavage system protein T) | Hypothetical protein, Transferase, Aminotransferase, Mitochondrion, Transit peptide, Disease mutation | 1910 | 5878 |
| NM_000487 | ARSA | arylsulfatase A | Hydrolase, Signal, Glycoprotein, Lysosome, Disease mutation, Metachromatic leukodystrophy, Sphingolipid metabolism, Polymorphism, 3D-structure | 1911 | 5879 |
| NM_000497 | CYP11B1 | cytochrome P450, family 11, subfamily B, polypeptide 1 | Steroidogenesis, Electron transport, Steroid metabolism, Oxidoreductase, Monooxygenase, Mitochondrion, Membrane, Heme, Transit peptide, Polymorphism, Disease mutation | 1912 | 5880 |
| NM_000502 | EPX | eosinophil peroxidase | Oxidoreductase, Peroxidase, Iron, Heme, Glycoprotein, Signal, Disease mutation | 1913 | 5881 |
| NM_000507 | FBP1 | fructose-1,6-bisphosphatase 1 | Hydrolase, Carbohydrate metabolism, Gluconeogenesis, Zinc, Allosteric enzyme, Disease mutation, Polymorphism, 3D-structure, Hypothetical protein | 1914 | 5882 |
| NM_000512 | GALNS | galactosamine (N-acetyl)-6-sulfate sulfatase (Morquio syndrome, mucopolysaccharidosis type IVA) | Hypothetical protein | 1915 | 5883 |
| NM_000517 | HBA2 | hemoglobin, alpha 2 | Heme, Oxygen transport, Transport, Erythrocyte, Disease mutation, Polymorphism, Acetylation, 3D-structure | 1916 | 5884 |
| NM_000525 | KCNJ11 | potassium inwardly-rectifying channel, subfamily J, member 11 | Ionic channel, Ion transport, Voltage-gated channel, Transmembrane, Potassium transport, Polymorphism, Disease mutation, Diabetes mellitus | 1917 | 5885 |
| NM_000528 | MAN2B1 | mannosidase, alpha, class 2B, member 1 | Glycosidase, Hydrolase, Glycoprotein, Lysosome, Zymogen, Signal, Disease mutation, Polymorphism | 1918 | 5886 |
| NM_000532 | PCCB | propionyl Coenzyme A carboxylase, beta polypeptide | Hypothetical protein, Mitochondrion, Transit peptide, Ligase, Disease mutation | 1919 | 5887 |
| NM_000542 | SFTPB | surfactant, pulmonary-associated protein B | Surface film, Gaseous exchange, Glycoprotein, Repeat, Polymorphism, 3D-structure | 1920 | 5888 |
| NM_000558 | HBA1 | hemoglobin, alpha 2 | Heme, Oxygen transport, Transport, Erythrocyte, Disease mutation, Polymorphism, Acetylation, 3D-structure | 1921 | 5889 |
| NM_000565 | IL6R | interleukin 6 receptor | Receptor, Transmembrane, Glycoprotein, Immunoglobulin domain, Repeat, Alternative splicing, Signal, 3D-structure | 1922 | 5890 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000569 | FCGR3A | Fc fragment of IgG, low affinity IIIa, receptor for (CD16) | IgG-binding protein, Receptor, Transmembrane, Glycoprotein, Signal, Immunoglobulin domain, Repeat, Multigene family, Polymorphism, GPI-anchor, 3D-structure, Lipoprotein | 1923 | 5891 |
| NM_000573 | CR1 | complement component (3b/4b) receptor 1, including Knops blood group system | Complement pathway, Glycoprotein, Transmembrane, Repeat, Signal, Receptor, Sushi, Blood group antigen, Polymorphism, Pyrrolidone carboxylic acid, 3D-structure | 1924 | 5892 |
| NM_000578 | SLC11A1 | solute carrier family 11 (proton-coupled divalent metal ion transporters), member 1 | Transport, Iron transport, Transmembrane, Glycoprotein, Macrophage, Polymorphism | 1925 | 5893 |
| NM_000581 | GPX1 | glutathione peroxidase 1 | Oxidoreductase, Peroxidase, Selenium, Selenocysteine, Erythrocyte, Polymorphism, Hypothetical protein | 1926 | 5894 |
| NM_000584 | IL8 | interleukin 8 | Cytokine, Chemotaxis, Inflammatory response, Signal, Alternative splicing, 3D-structure | 1927 | 5895 |
| NM_000591 | CD14 | CD14 antigen | Immune response, Inflammatory response, Signal, GPI-anchor, Repeat, Leucine-rich repeat, Glycoprotein, Antigen, Lipoprotein | 1928 | 5896 |
| NM_000607 | ORM1 | orosomucoid 1 | Glycoprotein, Plasma, Acute phase, Signal, Lipocalin, Polymorphism, Multigene family, Pyrrolidone carboxylic acid | 1929 | 5897 |
| NM_000608 | ORM2 | orosomucoid 1 | Glycoprotein, Plasma, Acute phase, Signal, Lipocalin, Multigene family, Polymorphism, Pyrrolidone carboxylic acid | 1930 | 5898 |
| NM_000631 | NCF4 | neutrophil cytosolic factor 4, 40 kDa | SH3 domain, Alternative splicing, 3D-structure | 1931 | 5899 |
| NM_000632 | ITGAM | integrin, alpha M (complement component receptor 3, alpha; also known as CD11b (p170), macrophage antigen alpha polypeptide) | Integrin, Cell adhesion, Receptor, Glycoprotein, Transmembrane, Signal, 3D-structure, Repeat, Magnesium, Calcium | 1932 | 5900 |
| NM_000633 | BCL2 | B-cell CLL/lymphoma 2 | Proto-oncogene, Apoptosis, Alternative splicing, Transmembrane, Mitochondrion, Phosphorylation, Chromosomal translocation, Polymorphism, Disease mutation, 3D-structure | 1933 | 5901 |
| NM_000634 | IL8RA | interleukin 8 receptor, alpha | G-protein coupled receptor, Transmembrane, Glycoprotein, Chemotaxis, Polymorphism, 3D-structure, Receptor | 1934 | 5902 |
| NM_000651 | CR1 | complement component (3b/4b) receptor 1, including Knops blood group system | Complement pathway, Glycoprotein, Transmembrane, Repeat, Signal, Receptor, Sushi, Blood group antigen, Polymorphism, Pyrrolidone carboxylic acid, 3D-structure | 1935 | 5903 |
| NM_000655 | SELL | selectin L (lymphocyte adhesion molecule 1) | EGF-like domain, Cell adhesion, Transmembrane, Glycoprotein, Lectin, Selectin, Signal, Sushi, Repeat, 3D-structure | 1936 | 5904 |
| NM_000671 | ADH5 | alcohol dehydrogenase 5 (class III), chi polypeptide | Oxidoreductase, Zinc, Metal-binding, NAD, Multigene family, Acetylation, 3D-structure | 1937 | 5905 |
| NM_000675 | ADORA2A | adenosine A2a receptor | G-protein coupled receptor, Transmembrane, Glycoprotein, 3D-structure, Polymorphism | 1938 | 5906 |
| NM_000688 | ALAS1 | aminolevulinate, delta-, synthase 1 | Heme biosynthesis, Transferase, Acyltransferase, Mitochondrion, Transit peptide, Pyridoxal phosphate, Multigene family | 1939 | 5907 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000690 | ALDH2 | aldehyde dehydrogenase 2 family (mitochondrial) | Oxidoreductase, NAD, Mitochondrion, Transit peptide, Polymorphism, 3D-structure | 1940 | 5908 |
| NM_000694 | ALDH3B1 | aldehyde dehydrogenase 3 family, member B1 | Oxidoreductase, NAD | 1941 | 5909 |
| NM_000698 | ALOX5 | arachidonate 5-lipoxygenase | Oxidoreductase, Dioxygenase, Iron, Leukotriene biosynthesis, Calcium | 1942 | 5910 |
| NM_000701 | ATP1A1 | ATPase, Na+/K+ transporting, alpha 1 polypeptide | Hydrolase, Sodium/potassium transport, Transmembrane, Phosphorylation, Magnesium, Metal-binding, ATP-binding, Multigene family, Alternative splicing | 1943 | 5911 |
| NM_000712 | BLVRA | biliverdin reductase A | Oxidoreductase, NAD, NADP, Zinc, Polymorphism | 1944 | 5912 |
| NM_000714 | BZRP | benzodiazapine receptor (peripheral) | Mitochondrion, Receptor, Transmembrane, Polymorphism | 1945 | 5913 |
| NM_000717 | CA4 | carbonic anhydrase IV | GPI-anchor, Membrane, Lyase, Zinc, Signal, 3D-structure, Lipoprotein | 1946 | 5914 |
| NM_000718 | CACNA1B | calcium channel, voltage-dependent, L type, alpha 1B subunit | Ionic channel, Transmembrane, Ion transport, Voltage-gated channel, Calcium channel, Glycoprotein, Repeat, Multigene family, Calcium-binding, Phosphorylation, ATP-binding, Alternative splicing | 1947 | 5915 |
| NM_000732 | CD3D | CD3D antigen, delta polypeptide (TiT3 complex) | Immunoglobulin domain, T-cell, Receptor, Transmembrane, Glycoprotein, Signal | 1948 | 5916 |
| NM_000734 | CD3Z | CD3Z antigen, zeta polypeptide (TiT3 complex) | T-cell, Receptor, Transmembrane, Signal, Repeat, Alternative splicing, Phosphorylation, 3D-structure | 1949 | 5917 |
| NM_000748 | CHRNB2 | cholinergic receptor, nicotinic, beta polypeptide 2 (neuronal) | Postsynaptic membrane, Ionic channel, Glycoprotein, Signal, Transmembrane, Multigene family, Disease mutation, Epilepsy | 1950 | 5918 |
| NM_000749 | CHRNB3 | cholinergic receptor, nicotinic, beta polypeptide 3 | Postsynaptic membrane, Ionic channel, Glycoprotein, Signal, Transmembrane, Multigene family | 1951 | 5919 |
| NM_000752 | LTB4R | leukotriene B4 receptor 2 | Apoptosis, 3D-structure, RNA-binding, Repeat, G-protein coupled receptor, Transmembrane, Glycoprotein | 1952 | 5920 |
| NM_000757 | CSF1 | colony stimulating factor 1 (macrophage) | Cytokine, Growth factor, Glycoprotein, Proteoglycan, Transmembrane, Signal, Alternative splicing, 3D-structure | 1953 | 5921 |
| NM_000760 | CSF3R | colony stimulating factor 3 receptor (granulocyte) | Cell adhesion, Receptor, Repeat, Signal, Transmembrane, Immunoglobulin domain, Glycoprotein, Alternative splicing, Polymorphism, 3D-structure | 1954 | 5922 |
| NM_000778 | CYP4A11 | cytochrome P450, family 4, subfamily A, polypeptide 11 | Heme, Monooxygenase, Oxidoreductase, Electron transport, Membrane, Microsome, Endoplasmic reticulum, Polymorphism | 1955 | 5923 |
| NM_000801 | FKBP1A | FK506 binding protein 1A, 12 kDa | Isomerase, Rotamase, 3D-structure | 1956 | 5924 |
| NM_000804 | FOLR3 | folate receptor 3 (gamma) | Receptor, Glycoprotein, Signal, Folate-binding, Multigene family, Alternative splicing | 1957 | 5925 |
| NM_000819 | GART | phosphoribosylglycinamide formyltransferase, phosphoribosylglycinamide synthetase, phosphoribosylaminoimidazole synthetase | Multifunctional enzyme, Purine biosynthesis, Ligase, Transferase, Alternative splicing, Polymorphism | 1958 | 5926 |
| NM_000846 | GSTA2 | glutathione S-transferase A2 | Transferase, Multigene family, Polymorphism, 3D-structure | 1959 | 5927 |
| NM_000856 | GUCY1A3 | guanylate cyclase 1, soluble, alpha 3 | Lyase, cGMP biosynthesis, Multigene family | 1960 | 5928 |
| NM_000857 | GUCY1B3 | guanylate cyclase 1, soluble, beta 3 | Lyase, cGMP biosynthesis, Alternative splicing | 1961 | 5929 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_000871 | HTR6 | 5-hydroxytryptamine (serotonin) receptor 6 | G-protein coupled receptor, Transmembrane, Glycoprotein, Multigene family | 1962 | 5930 |
| NM_000876 | IGF2R | insulin-like growth factor 2 receptor | Transmembrane, Transport, Glycoprotein, Repeat, Receptor, Lysosome, Signal, Polymorphism, 3D-structure | 1963 | 5931 |
| NM_000877 | IL1R1 | interleukin 1 receptor, type I | Receptor, Repeat, Signal, Transmembrane, Immunoglobulin domain, Glycoprotein, Phosphorylation, 3D-structure | 1964 | 5932 |
| NM_000878 | IL2RB | interleukin 2 receptor, beta | Receptor, Transmembrane, Glycoprotein, Signal, 3D-structure | 1965 | 5933 |
| NM_000883 | IMPDH1 | IMP (inosine monophosphate) dehydrogenase 1 | Oxidoreductase, NAD, GMP biosynthesis, Purine biosynthesis, Multigene family, Repeat, CBS domain, Alternative splicing, Vision, *Retinitis pigmentosa*, Disease mutation | 1966 | 5934 |
| NM_000895 | LTA4H | leukotriene A4 hydrolase | Multifunctional enzyme, Hydrolase, Leukotriene biosynthesis, Metalloprotease, Metal-binding, Zinc, 3D-structure | 1967 | 5935 |
| NM_000903 | NQO1 | NAD(P)H dehydrogenase, quinone 1 | Oxidoreductase, NAD, NADP, Flavoprotein, FAD, Multigene family, Polymorphism, 3D-structure | 1968 | 5936 |
| NM_000904 | NQO2 | NAD(P)H dehydrogenase, quinone 2 | Oxidoreductase, Flavoprotein, FAD, Multigene family, Zinc, 3D-structure | 1969 | 5937 |
| NM_000918 | P4HB | procollagen-proline, 2-oxoglutarate 4-dioxygenase (proline 4-hydroxylase), beta polypeptide (protein disulfide isomerase; thyroid hormone binding protein p55) | Redox-active center, Isomerase, Endoplasmic reticulum, Repeat, Signal, 3D-structure, Hypothetical protein | 1970 | 5938 |
| NM_000952 | PTAFR | platelet-activating factor receptor | G-protein coupled receptor, Transmembrane, Glycoprotein, Chemotaxis, Polymorphism, Hypothetical protein | 1971 | 5939 |
| NM_000954 | PTGDS | prostaglandin D2 synthase 21 kDa (brain) | Isomerase, Prostaglandin biosynthesis, Transport, Glycoprotein, Signal, Membrane, Lipocalin, Polymorphism | 1972 | 5940 |
| NM_000963 | PTGS2 | prostaglandin-endoperoxide synthase 2 (prostaglandin G/H synthase and cyclooxygenase) | Oxidoreductase, Dioxygenase, Peroxidase, Glycoprotein, Prostaglandin biosynthesis, Heme, Iron, Signal, Membrane, Polymorphism | 1973 | 5941 |
| NM_000966 | RARG | retinoic acid receptor, gamma | Receptor, Transcription regulation, DNA-binding, Nuclear protein, Zinc-finger, Multigene family, Alternative splicing, 3D-structure | 1974 | 5942 |
| NM_000969 | RPL5 | ribosomal protein L5 | Ribosomal protein, rRNA-binding, Hydrolase, Metalloprotease, Aminopeptidase, Zinc, Nuclear protein | 1975 | 5943 |
| NM_000985 | RPL17 | ribosomal protein L17 | Hypothetical protein, Ribosomal protein | 1976 | 5944 |
| NM_000992 | RPL29 | ribosomal protein L29 | Methylation, Ribosomal protein, Repeat, Heparin-binding | 1977 | 5945 |
| NM_000995 | RPL34 | ribosomal protein L34 | Ribosomal protein | 1978 | 5946 |
| NM_001006 | RPS3A | ribosomal protein S3A | Ribosomal protein | 1979 | 5947 |
| NM_001017 | RPS13 | ribosomal protein S13 | Ribosomal protein | 1980 | 5948 |
| NM_001048 | SST | somatostatin | Cleavage on pair of basic residues, Hormone, Signal, Pharmaceutical | 1981 | 5949 |
| NM_001051 | SSTR3 | somatostatin receptor 3 | G-protein coupled receptor, Transmembrane, Glycoprotein, Multigene family, Polymorphism | 1982 | 5950 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001052 | SSTR4 | somatostatin receptor 4 | G-protein coupled receptor, Transmembrane, Glycoprotein, Multigene family, Lipoprotein, Palmitate, Phosphorylation, Polymorphism | 1983 | 5951 |
| NM_001054 | SULT1A2 | sulfotransferase family, cytosolic, 1A, phenol-preferring, member 2 | Transferase, Steroid metabolism, Polymorphism | 1984 | 5952 |
| NM_001055 | SULT1A1 | sulfotransferase family, cytosolic, 1A, phenol-preferring, member 1 | Transferase, Catecholamine metabolism, Steroid metabolism, Polymorphism | 1985 | 5953 |
| NM_001060 | TBXA2R | thromboxane A2 receptor | G-protein coupled receptor, Transmembrane, Glycoprotein, Disease mutation, Alternative splicing, Polymorphism, 3D-structure, Hypothetical protein, Metal-binding, Nuclear protein, Zinc, Zinc-finger | 1986 | 5954 |
| NM_001062 | TCN1 | transcobalamin I (vitamin B12 binding protein, R binder family) | Transport, Cobalt transport, Glycoprotein, Signal | 1987 | 5955 |
| NM_001064 | TKT | transketolase (Wernicke-Korsakoff syndrome) | Transferase, Thiamine pyrophosphate, Calcium-binding | 1988 | 5956 |
| NM_001065 | TNFRSF1A | tumor necrosis factor receptor superfamily, member 1A | Receptor, Apoptosis, Transmembrane, Glycoprotein, Repeat, Signal, Disease mutation, Polymorphism, 3D-structure | 1989 | 5957 |
| NM_001066 | TNFRSF1B | tumor necrosis factor receptor superfamily, member 1B | Receptor, Apoptosis, Transmembrane, Glycoprotein, Repeat, Signal, Phosphorylation, Pharmaceutical, Polymorphism, 3D-structure | 1990 | 5958 |
| NM_001082 | CYP4F2 | cytochrome P450, family 4, subfamily F, polypeptide 2 | Heme, Monooxygenase, Oxidoreductase, Electron transport, Membrane, Microsome, Endoplasmic reticulum, Polymorphism, NADP | 1991 | 5959 |
| NM_001087 | AAMP | angio-associated, migratory cell protein | Repeat, WD repeat | 1992 | 5960 |
| NM_001089 | ABCA3 | ATP-binding cassette, sub-family A (ABC1), member 3 | ATP-binding, Transport, Transmembrane | 1993 | 5961 |
| NM_001090 | ABCF1 | ATP-binding cassette, sub-family F (GCN20), member 1 | ATP-binding | 1994 | 5962 |
| NM_001091 | ABP1 | amiloride binding protein 1 (amine oxidase (copper-containing)) | Signal, Glycoprotein, Oxidoreductase, Copper, Heparin-binding, TPQ, Alternative splicing, Polymorphism, Metal-binding | 1995 | 5963 |
| NM_001099 | ACPP | acid phosphatase, prostate | Hydrolase, Glycoprotein, Signal, 3D-structure | 1996 | 5964 |
| NM_001101 | ACTB | actin, beta | Hypothetical protein, Structural protein, Multigene family, Methylation, Acetylation, Cytoskeleton, 3D-structure | 1997 | 5965 |
| NM_001102 | ACTN1 | actinin, alpha 1 | Cytoskeleton, Actin-binding, Calcium-binding, Repeat, Multigene family, Phosphorylation | 1998 | 5966 |
| NM_001105 | ACVR1 | activin A receptor, type I | Receptor, Transferase, Serine/threonine-protein kinase, ATP-binding, Transmembrane, Glycoprotein, Signal | 1999 | 5967 |
| NM_001107 | ACYP1 | acylphosphatase 1, erythrocyte (common) type | Hydrolase, Acetylation, Multigene family | 2000 | 5968 |
| NM_001109 | ADAM8 | a disintegrin and metalloproteinase domain 8 | Hydrolase, Metalloprotease, Zinc, Signal, Glycoprotein, Transmembrane, Antigen, EGF-like domain | 2001 | 5969 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001120 | TETRAN | tetracycline transporter-like protein | Transmembrane | 2002 | 5970 |
| NM_001129 | AEBP1 | AE binding protein 1 | Carboxypeptidase | 2003 | 5971 |
| NM_001140 | ALOX15 | arachidonate 15-lipoxygenase | Oxidoreductase, Dioxygenase, Iron, Leukotriene biosynthesis | 2004 | 5972 |
| NM_001150 | ANPEP | alanyl (membrane) aminopeptidase (aminopeptidase N, aminopeptidase M, microsomal aminopeptidase, CD13, p150) | Angiogenesis, Hydrolase, Aminopeptidase, Metalloprotease, Zinc, Signal-anchor, Transmembrane, Glycoprotein, Sulfation, Polymorphism | 2005 | 5973 |
| NM_001152 | SLC25A5 | solute carrier family 25 (mitochondrial carrier; adenine nucleotide translocator), member 5 | Mitochondrion, Inner membrane, Repeat, Transmembrane, Transport, Multigene family | 2006 | 5974 |
| NM_001153 | ANXA4 | annexin A4 | Annexin, Calcium/phospholipid-binding, Repeat | 2007 | 5975 |
| NM_001155 | ANXA6 | annexin A6 | Annexin, Calcium/phospholipid-binding, Repeat, Acetylation, Phosphorylation, 3D-structure | 2008 | 5976 |
| NM_001157 | ANXA11 | annexin A11 | Annexin, Calcium/phospholipid-binding, Repeat, Polymorphism | 2009 | 5977 |
| NM_001172 | ARG2 | arginase, type II | Urea cycle, Arginine metabolism, Hydrolase, Manganese, Transit peptide, Mitochondrion, Receptor, Transmembrane, Transport, Protein transport, Coiled coil, Alternative splicing | 2010 | 5978 |
| NM_001175 | ARHGDIB | Rho GDP dissociation inhibitor (GDI) beta | GTPase activation, 3D-structure | 2011 | 5979 |
| NM_001181 | ASGR2 | asialoglycoprotein receptor 2 | Lectin, Glycoprotein, Receptor, Endocytosis, Transmembrane, Calcium, Signal-anchor, Phosphorylation, Alternative splicing | 2012 | 5980 |
| NM_001182 | ALDH7A1 | aldehyde dehydrogenase 7 family, member A1 | Oxidoreductase, NAD | 2013 | 5981 |
| NM_001183 | ATP6IP1 | ATPase, H+ transporting, lysosomal accessory protein 1 | Hypothetical protein, ATP synthesis, Hydrogen ion transport, Hydrolase, ATP-binding, Transmembrane, Glycoprotein, Signal | 2014 | 5982 |
| NM_001184 | ATR | ataxia telangiectasia and Rad3 related | Kinase, Transferase | 2015 | 5983 |
| NM_001196 | BID | BH3 interacting domain death agonist | Apoptosis, 3D-structure | 2016 | 5984 |
| NM_001199 | BMP1 | bone morphogenetic protein 1 | Growth factor, Cytokine, Repeat, Osteogenesis, Chondrogenesis, Hydrolase, Metalloprotease, EGF-like domain, Zinc, Calcium, Signal, Glycoprotein, Zymogen, Alternative splicing, Collagen | 2017 | 5985 |
| NM_001206 | BTEB1 | basic transcription element binding protein 1 | Transcription regulation, DNA-binding, Nuclear protein, Repeat, Zinc-finger, Metal-binding | 2018 | 5986 |
| NM_001207 | BTF3 | basic transcription factor 3 | Transcription regulation, Nuclear protein, Alternative splicing | 2019 | 5987 |
| NM_001208 | BTF3L1 | basic transcription factor 3, like 1 | Transcription regulation, Nuclear protein | 2020 | 5988 |
| NM_001212 | C1QBP | complement component 1, q subcomponent binding protein | Mitochondrion, Transit peptide, 3D-structure, Hypothetical protein | 2021 | 5989 |
| NM_001222 | CAMK2G | calcium/calmodulin-dependent protein kinase (CaM kinase) II gamma | Alternative splicing | 2022 | 5990 |
| NM_001237 | CCNA2 | cyclin A2 | Cyclin, Cell cycle, Cell division, Mitosis, 3D-structure | 2023 | 5991 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001252 | TNFSF7 | tumor necrosis factor (ligand) superfamily, member 7 | Cytokine, Transmembrane, Glycoprotein, Signal-anchor, Antigen | 2024 | 5992 |
| NM_001256 | CDC27 | cell division cycle 27 | Repeat, TPR repeat, Nuclear protein, Polymorphism | 2025 | 5993 |
| NM_001259 | CDK6 | cyclin-dependent kinase 6 | Transferase, Serine/threonine-protein kinase, ATP-binding, Cell cycle, Cell division, Phosphorylation, 3D-structure | 2026 | 5994 |
| NM_001266 | CES1 | carboxylesterase 1 (monocyte/macrophage serine esterase 1) | Glycoprotein, Hydrolase, Serine esterase, Endoplasmic reticulum, Signal, Multigene family, Polymorphism, Hypothetical protein | 2027 | 5995 |
| NM_001276 | CHI3L1 | chitinase 3-like 1 (cartilage glycoprotein-39) | Glycoprotein, Signal, 3D-structure | 2028 | 5996 |
| NM_001282 | AP2B1 | adaptor-related protein complex 2, beta 1 subunit | Hypothetical protein, Coated pits, 3D-structure | 2029 | 5997 |
| NM_001284 | AP3S1 | adaptor-related protein complex 3, sigma 1 subunit | Golgi stack, Protein transport, Transport | 2030 | 5998 |
| NM_001286 | CLCN6 | chloride channel 6 | Ionic channel, Ion transport, Chloride channel, Chloride, Voltage-gated channel, Transmembrane, CBS domain, Repeat, Alternative splicing | 2031 | 5999 |
| NM_001288 | CLIC1 | chloride intracellular channel 1 | Ionic channel, Ion transport, Chloride channel, Chloride, Voltage-gated channel, Nuclear protein, 3D-structure | 2032 | 6000 |
| NM_001292 | CLK3 | CDC-like kinase 3 | Transferase, Serine/threonine-protein kinase, ATP-binding, Tyrosine-protein kinase, Phosphorylation, Nuclear protein, Alternative splicing | 2033 | 6001 |
| NM_001293 | CLNS1A | chloride channel, nucleotide-sensitive, 1A | Nuclear protein, Polymorphism | 2034 | 6002 |
| NM_001294 | CLPTM1 | cleft lip and palate associated transmembrane protein 1 | Transmembrane | 2035 | 6003 |
| NM_001305 | CLDN4 | claudin 4 | Tight junction, Transmembrane, Williams-Beuren syndrome | 2036 | 6004 |
| NM_001313 | CRMP1 | collapsin response mediator protein 1 | Repeat, WD repeat | 2037 | 6005 |
| NM_001315 | MAPK14 | mitogen-activated protein kinase 14 | ATP-binding, Kinase, Transferase, Serine/threonine-protein kinase, Phosphorylation, Alternative splicing, 3D-structure | 2038 | 6006 |
| NM_001317 | CSH1 | chorionic somatomammotropin hormone 1 (placental lactogen) | Chorion, Hormone, Placenta, Multigene family, Signal | 2039 | 6007 |
| NM_001325 | CSTF2 | cleavage stimulation factor, 3' pre-RNA, subunit 2, 64 kDa | RNA-binding, Repeat, Phosphorylation, Nuclear protein | 2040 | 6008 |
| NM_001331 | CTNND1 | catenin (cadherin-associated protein), delta 1 | Cytoskeleton, Structural protein, Phosphorylation, Repeat, Cell adhesion, Coiled coil, Nuclear protein, Alternative splicing | 2041 | 6009 |
| NM_001338 | CXADR | coxsackie virus and adenovirus receptor | Immunoglobulin domain, Receptor, Transmembrane, Glycoprotein, Signal, Repeat, 3D-structure | 2042 | 6010 |
| NM_001346 | DGKG | diacylglycerol kinase, gamma 90 kDa | Transferase, Kinase, Calcium-binding, Phorbol-ester binding, Repeat, Multigene family, Alternative splicing | 2043 | 6011 |
| NM_001357 | DDX9 | DEAH (Asp-Glu-Ala-His) box polypeptide 9 | Helicase, RNA-binding, DNA-binding, Repeat, Nuclear protein, ATP-binding | 2044 | 6012 |
| NM_001358 | DDX15 | DEAH (Asp-Glu-Ala-His) box polypeptide 15 | mRNA processing, mRNA splicing, Helicase, ATP-binding, Nuclear protein | 2045 | 6013 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001363 | DKC1 | dyskeratosis congenita 1, dyskerin | Telomere, RNA-binding, Nuclear protein, Disease mutation | 2046 | 6014 |
| NM_001381 | DOK1 | docking protein 1, 62 kDa (downstream of tyrosine kinase 1) | Phosphorylation, Alternative splicing | 2047 | 6015 |
| NM_001383 | DPH2L1 | diptheria toxin resistance protein required for diphthamide biosynthesis-like 1 (S. cerevisiae) | | 2048 | 6016 |
| NM_001388 | DRG2 | developmentally regulated GTP binding protein 2 | GTP-binding | 2049 | 6017 |
| NM_001406 | EFNB3 | ephrin-B3 | Developmental protein, Neurogenesis, Transmembrane, Glycoprotein, Signal, Polymorphism | 2050 | 6018 |
| NM_001415 | EIF2S3 | eukaryotic translation initiation factor 2, subunit 3 gamma, 52 kDa | Initiation factor, Protein biosynthesis, GTP-binding, Polymorphism | 2051 | 6019 |
| NM_001419 | ELAVL1 | ELAV (embryonic lethal, abnormal vision, Drosophila)-like 1 (Hu antigen R) | RNA-binding, Repeat | 2052 | 6020 |
| NM_001421 | ELF4 | E74-like factor 4 (ets domain transcription factor) | | 2053 | 6021 |
| NM_001423 | EMP1 | epithelial membrane protein 1 | Transmembrane, Glycoprotein | 2054 | 6022 |
| NM_001431 | EPB41L2 | erythrocyte membrane protein band 4.1-like 2 | Hypothetical protein, Structural protein, Cytoskeleton, Actin-binding | 2055 | 6023 |
| NM_001432 | EREG | epiregulin | Angiogenesis, Growth factor, Mitogen, Glycoprotein, EGF-like domain, Transmembrane, Signal | 2056 | 6024 |
| NM_001440 | EXTL3 | exostoses (multiple)-like 3 | Transferase, Glycosyltransferase, Endoplasmic reticulum, Transmembrane, Signal-anchor, Glycoprotein | 2057 | 6025 |
| NM_001444 | FABP5 | fatty acid binding protein 5 (psoriasis-associated) | Transport, Lipid-binding, 3D-structure | 2058 | 6026 |
| NM_001449 | FHL1 | four and a half LIM domains 1 | Coiled coil, Transcription regulation, Nuclear protein, Disease mutation, Anhidrotic ectodermal dysplasia, Repeat, LIM domain, Metal-binding, Zinc, Developmental protein, Differentiation, Zinc-finger | 2059 | 6027 |
| NM_001455 | FOXO3A | forkhead box O3A | Transcription regulation, DNA-binding, Nuclear protein, Apoptosis, Chromosomal translocation, Proto-oncogene, Phosphorylation | 2060 | 6028 |
| NM_001456 | FLNA | filamin A, alpha (actin binding protein 280) | Cytoskeleton, Actin-binding, Repeat, Phosphorylation, Polymorphism, Disease mutation, Multigene family, Hypothetical protein | 2061 | 6029 |
| NM_001462 | FPRL1 | formyl peptide receptor-like 1 | G-protein coupled receptor, Transmembrane, Glycoprotein, Chemotaxis, Repeat, WD repeat | 2062 | 6030 |
| NM_001465 | FYB | FYN binding protein (FYB-120/130) | SH3 domain, Phosphorylation, Nuclear protein, Coiled coil, Alternative splicing | 2063 | 6031 |
| NM_001467 | G6PT1 | solute carrier family 37 (glycerol-6-phosphate transporter), member 4 | Transmembrane, Transport, Sugar transport, Endoplasmic reticulum, Alternative splicing, Glycogen storage disease, Disease mutation | 2064 | 6032 |
| NM_001469 | G22P1 | thyroid autoantigen 70 kDa (Ku antigen) | Helicase, Nuclear protein, DNA-binding, Phosphorylation, Antigen, Systemic lupus erythematosus, Acetylation, 3D-structure | 2065 | 6033 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001478 | GALGT | UDP-N-acetyl-alpha-D-galactosamine:(N-acetylneuraminyl)-galactosylglucosylceramide N-acetylgalactosaminyl transferase (GalNAc-T) | Hypothetical protein, Transferase, Glycosyltransferase, Transmembrane, Signal-anchor, Golgi stack, Glycoprotein, Polymorphism | 2066 | 6034 |
| NM_001482 | GATM | glycine amidinotransferase (L-arginine:glycine amidinotransferase) | Transferase, Mitochondrion, Transit peptide, 3D-structure, Alternative splicing | 2067 | 6035 |
| NM_001483 | GBAS | glioblastoma amplified sequence | | 2068 | 6036 |
| NM_001487 | GCN5L1 | GCN5 general control of amino-acid synthesis 5-like 1 (yeast) | | 2069 | 6037 |
| NM_001493 | GDI1 | GDP dissociation inhibitor 1 | GTPase activation, Disease mutation | 2070 | 6038 |
| NM_001500 | GMDS | GDP-mannose 4,6-dehydratase | Lyase, NADP | 2071 | 6039 |
| NM_001503 | GPLD1 | glycosylphosphatidyl inositol specific phospholipase D1 | Hydrolase, Glycoprotein, Signal, Hypothetical protein | 2072 | 6040 |
| NM_001504 | CXCR3 | chemokine (C—X—C motif) receptor 3 | G-protein coupled receptor, Transmembrane, Glycoprotein, Antigen, Polymorphism | 2073 | 6041 |
| NM_001517 | GTF2H4 | general transcription factor IIH, polypeptide 4, 52 kDa | Transcription regulation, DNA repair, Nuclear protein | 2074 | 6042 |
| NM_001518 | GTF2I | general transcription factor II, i | Transcription regulation, DNA-binding, Nuclear protein, Phosphorylation, Repeat, Williams-Beuren syndrome, Alternative splicing | 2075 | 6043 |
| NM_001519 | BRF1 | BRF1 homolog, subunit of RNA polymerase III transcription initiation factor IIIB (S. cerevisiae) | Transcription regulation, Activator, Nuclear protein, Repeat, Zinc-finger, Metal-binding, Zinc, Alternative splicing, Hypothetical protein | 2076 | 6044 |
| NM_001520 | GTF3C1 | general transcription factor IIIC, polypeptide 1, alpha 220 kDa | | 2077 | 6045 |
| NM_001528 | HGFAC | HGF activator | Hydrolase, Glycoprotein, Plasma, Serine protease, Kringle, Signal, EGF-like domain, Repeat, Zymogen | 2078 | 6046 |
| NM_001531 | MR1 | major histocompatibility complex, class I-related | MHC, Glycoprotein, Transmembrane | 2079 | 6047 |
| NM_001536 | HRMT1L2 | HMT1 hnRNP methyltransferase-like 2 (S. cerevisiae) | Transferase, Methyltransferase, Nuclear protein, Alternative splicing | 2080 | 6048 |
| NM_001538 | HSF4 | F-box and leucine-rich repeat protein 8 | Transcription regulation, Nuclear protein, DNA-binding, Activator, Repressor, Heat shock, Multigene family, Alternative splicing | 2081 | 6049 |
| NM_001539 | DNAJA1 | DnaJ (Hsp40) homolog, subfamily A, member 1 | Chaperone, Repeat, Zinc, Metal-binding, Prenylation, Lipoprotein, Multigene family | 2082 | 6050 |
| NM_001550 | IFRD1 | interferon-related developmental regulator 1 | | 2083 | 6051 |
| NM_001551 | IGBP1 | immunoglobulin (CD79A) binding protein 1 | B-cell activation, Phosphorylation | 2084 | 6052 |
| NM_001554 | CYR61 | cysteine-rich, angiogenic inducer, 61 | Plasmid, Chemotaxis, Cell adhesion, Growth factor binding, Heparin-binding, Signal | 2085 | 6053 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001557 | IL8RB | interleukin 8 receptor, beta | G-protein coupled receptor, Transmembrane, Glycoprotein, Chemotaxis, Polymorphism, Receptor | 2086 | 6054 |
| NM_001558 | IL10RA | interleukin 10 receptor, alpha | Receptor, Transmembrane, Glycoprotein, Signal, Polymorphism, 3D-structure | 2087 | 6055 |
| NM_001567 | INPPL1 | inositol polyphosphate phosphatase-like 1 | DNA repair | 2088 | 6056 |
| NM_001572 | IRF7 | interferon regulatory factor 7 | Transcription regulation, DNA-binding, Nuclear protein, Activator, Alternative splicing, Collagen | 2089 | 6057 |
| NM_001607 | ACAA1 | acetyl-Coenzyme A acyltransferase 1 (peroxisomal 3-oxoacyl-Coenzyme A thiolase) | Acyltransferase, Transferase, Fatty acid metabolism, Peroxisome, Transit peptide, Polymorphism | 2090 | 6058 |
| NM_001618 | ADPRT | ADP-ribosyltransferase (NAD+; poly (ADP-ribose) polymerase) | Transferase, Glycosyltransferase, NAD, DNA-binding, Nuclear protein, ADP-ribosylation, Zinc-finger, Zinc, Polymorphism | 2091 | 6059 |
| NM_001619 | ADRBK1 | adrenergic, beta, receptor kinase 1 | Kinase, Receptor, Transferase, Serine/threonine-protein kinase, ATP-binding, Multigene family, 3D-structure | 2092 | 6060 |
| NM_001621 | AHR | aryl hydrocarbon receptor | Cell cycle, Transcription regulation, Activator, Receptor, DNA-binding, Nuclear protein, Repeat, Polymorphism | 2093 | 6061 |
| NM_001628 | AKR1B1 | aldo-keto reductase family 1, member B1 (aldose reductase) | Oxidoreductase, NADP, Acetylation, 3D-structure, Polymorphism | 2094 | 6062 |
| NM_001629 | ALOX5AP | arachidonate 5-lipoxygenase-activating protein | Transmembrane, Leukotriene biosynthesis | 2095 | 6063 |
| NM_001632 | ALPP | alkaline phosphatase, placental (Regan isozyme) | Hydrolase, Zinc, Magnesium, Phosphorylation, Transmembrane, Placenta, Multigene family, Glycoprotein, GPI-anchor, Signal, 3D-structure, Lipoprotein | 2096 | 6064 |
| NM_001634 | AMD1 | adenosylmethionine decarboxylase 1 | Spermidine biosynthesis, Lyase, Decarboxylase, Pyruvate, Zymogen, 3D-structure | 2097 | 6065 |
| NM_001637 | AOAH | acyloxyacyl hydrolase (neutrophil) | Hydrolase, Signal, Transmembrane, Glycoprotein | 2098 | 6066 |
| NM_001643 | APOA2 | apolipoprotein A-II | Transport, Lipid transport, HDL, Signal, Pyrrolidone carboxylic acid, 3D-structure | 2099 | 6067 |
| NM_001654 | ARAF1 | v-raf murine sarcoma 3611 viral oncogene homolog 1 | Transferase, Serine/threonine-protein kinase, Proto-oncogene, Metal-binding, Zinc, ATP-binding, Phorbol-ester binding, Kinase | 2100 | 6068 |
| NM_001657 | AREG | amphiregulin (schwannoma-derived growth factor) | Glycoprotein, Cytokine, Growth factor, EGF-like domain, Signal, Transmembrane | 2101 | 6069 |
| NM_001662 | ARF5 | ADP-ribosylation factor 5 | GTP-binding, Multigene family, Myristate, Protein transport, Golgi stack, Lipoprotein | 2102 | 6070 |
| NM_001665 | ARHG | ras homolog gene family, member G (rho G) | GTP-binding, Prenylation, Lipoprotein | 2103 | 6071 |
| NM_001667 | ARL2 | sorting nexin 15 | GTP-binding, Multigene family, Hypothetical protein, Transport, Protein transport, Alternative splicing | 2104 | 6072 |
| NM_001670 | ARVCF | armadillo repeat gene deletes in velocardiofacial syndrome | Hypothetical protein, Cell adhesion, Cytoskeleton, Structural protein, Repeat, Coiled coil, Alternative splicing | 2105 | 6073 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001671 | ASGR1 | asialoglycoprotein receptor 1 | Lectin, Glycoprotein, Receptor, Endocytosis, Transmembrane, Calcium, Signal-anchor, Phosphorylation, 3D-structure | 2106 | 6074 |
| NM_001677 | ATP1B1 | ATPase, Na+/K+ transporting, beta 1 polypeptide | Transferase, Kinase, ATP-binding, Sodium/potassium transport, Transmembrane, Glycoprotein, Multigene family, Signal-anchor, Alternative splicing | 2107 | 6075 |
| NM_001678 | ATP1B2 | ATPase, Na+/K+ transporting, beta 2 polypeptide | Sodium/potassium transport, Transmembrane, Glycoprotein, Multigene family, Signal-anchor | 2108 | 6076 |
| NM_001679 | ATP1B3 | ATPase, Na+/K+ transporting, beta 3 polypeptide | Sodium/potassium transport, Transmembrane, Glycoprotein, Multigene family, Signal-anchor | 2109 | 6077 |
| NM_001681 | ATP2A2 | ATPase, Ca++ transporting, cardiac muscle, slow twitch 2 | Hydrolase, Calcium transport, Transmembrane, Phosphorylation, ATP-binding, Metal-binding, Magnesium, Calcium-binding, Multigene family, Alternative splicing, Disease mutation, Epilepsy | 2110 | 6078 |
| NM_001693 | ATP6V1B2 | ATPase, H+ transporting, lysosomal 56/58 kDa, V1 subunit B, isoform 2 | Hydrolase, ATP synthesis, Hydrogen ion transport, Multigene family | 2111 | 6079 |
| NM_001706 | BCL6 | B-cell CLL/lymphoma 6 (zinc finger protein 51) | Nuclear protein, Transcription regulation, Activator, DNA-binding, Zinc-finger, Metal-binding, Repeat, Proto-oncogene, Chromosomal translocation, Polymorphism | 2112 | 6080 |
| NM_001712 | CEACAM1 | carcinoembryonic antigen-related cell adhesion molecule 1 (biliary glycoprotein) | Alternative splicing, Immunoglobulin domain, Signal, Transmembrane, Glycoprotein, Repeat, Pyrrolidone carboxylic acid, Hypothetical protein | 2113 | 6081 |
| NM_001714 | BICD1 | Bicaudal D homolog 1 (Drosophila) | Golgi stack, Coiled coil, Alternative splicing | 2114 | 6082 |
| NM_001716 | BLR1 | Burkitt lymphoma receptor 1, GTP binding protein (chemokine (C—X—C motif) receptor 5) | B-cell activation, G-protein coupled receptor, Transmembrane, Glycoprotein, Alternative splicing, Polymorphism | 2115 | 6083 |
| NM_001721 | BMX | BMX non-receptor tyrosine kinase | Transferase, Tyrosine-protein kinase, Phosphorylation, ATP-binding, SH3 domain, SH2 domain | 2116 | 6084 |
| NM_001725 | BPI | bactericidal/permeability-increasing protein | Antibiotic, Signal, Transmembrane, Glycoprotein, 3D-structure | 2117 | 6085 |
| NM_001728 | BSG | basigin (OK blood group) | Immunoglobulin domain, Transmembrane, Glycoprotein, Signal, Antigen, Blood group antigen, Polymorphism | 2118 | 6086 |
| NM_001730 | KLF5 | Kruppel-like factor 5 (intestinal) | Transcription regulation, DNA-binding, Nuclear protein, Repeat, Zinc-finger, Metal-binding, Activator | 2119 | 6087 |
| NM_001731 | BTG1 | B-cell translocation gene 1, anti-proliferative | Proto-oncogene, Chromosomal translocation | 2120 | 6088 |
| NM_001736 | C5R1 | complement component 5 receptor 1 (C5a ligand) | G-protein coupled receptor, Transmembrane, Glycoprotein, Sulfation, Chemotaxis | 2121 | 6089 |
| NM_001745 | CAMLG | calcium modulating ligand | Transmembrane | 2122 | 6090 |
| NM_001747 | CAPG | capping protein (actin filament), gelsolin-like | Nuclear protein, Actin-binding, Repeat, 3D-structure, Actin capping | 2123 | 6091 |
| NM_001749 | CAPNS1 | calpain, small subunit 1 | Calcium-binding, Repeat, 3D-structure | 2124 | 6092 |
| NM_001750 | CAST | calpastatin | Repeat, Thiol protease inhibitor, Alternative splicing, Phosphorylation, Signal transduction inhibitor | 2125 | 6093 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001767 | CD2 | CD2 antigen (p50), sheep red blood cell receptor | Immunoglobulin domain, T-cell, Glycoprotein, Antigen, Transmembrane, Cell adhesion, Repeat, Signal, Polymorphism, 3D-structure | 2126 | 6094 |
| NM_001769 | CD9 | CD9 antigen (p24) | Glycoprotein, Antigen, Transmembrane, Lipoprotein, Phosphorylation | 2127 | 6095 |
| NM_001771 | CD22 | CD22 antigen | Cell adhesion, Lectin, Antigen, Transmembrane, Signal, Glycoprotein, Immunoglobulin domain, Repeat, Phosphorylation, Alternative splicing, Polymorphism | 2128 | 6096 |
| NM_001773 | CD34 | CD34 antigen | Cell adhesion, Antigen, Signal, Transmembrane, Glycoprotein, Phosphorylation, Alternative splicing | 2129 | 6097 |
| NM_001774 | CD37 | CD37 antigen | Glycoprotein, Antigen, Transmembrane, Hypothetical protein | 2130 | 6098 |
| NM_001776 | ENTPD1 | ectonucleoside triphosphate diphosphohydrolase 1 | Hydrolase, Transmembrane, Antigen, Glycoprotein, Calcium, Magnesium, Alternative splicing, Lipoprotein, Palmitate | 2131 | 6099 |
| NM_001777 | CD47 | CD47 antigen (Rh-related antigen, integrin-associated signal transducer) | Cell adhesion, Antigen, Signal, Transmembrane, Glycoprotein, Alternative splicing | 2132 | 6100 |
| NM_001780 | CD63 | CD63 antigen (melanoma 1 antigen) | Glycoprotein, Antigen, Transmembrane, Lysosome | 2133 | 6101 |
| NM_001781 | CD69 | CD69 antigen (p60, early T-cell activation antigen) | Antigen, Signal-anchor, Transmembrane, Lectin, Glycoprotein, Phosphorylation, 3D-structure | 2134 | 6102 |
| NM_001800 | CDKN2D | cyclin-dependent kinase inhibitor 2D (p19, inhibits CDK4) | Cell cycle, Anti-oncogene, Repeat, ANK repeat, 3D-structure | 2135 | 6103 |
| NM_001803 | CDW52 | CDW52 antigen (CAMPATH-1 antigen) | Antigen, Signal, Glycoprotein, GPI-anchor, Membrane, Polymorphism, Lipoprotein | 2136 | 6104 |
| NM_001805 | CEBPE | CCAAT/enhancer binding protein (C/EBP), epsilon | Transcription regulation, Activator, DNA-binding, Nuclear protein, Phosphorylation | 2137 | 6105 |
| NM_001806 | CEBPG | CCAAT/enhancer binding protein (C/EBP), gamma | Transcription regulation, Activator, DNA-binding, Nuclear protein | 2138 | 6106 |
| NM_001808 | CELL | carboxyl ester lipase pseudogene | | 2139 | 6107 |
| NM_001815 | CEACAM3 | carcinoembryonic antigen-related cell adhesion molecule 3 | Immunoglobulin domain, Antigen, Signal, Glycoprotein, Transmembrane, Alternative splicing, Polymorphism | 2140 | 6108 |
| NM_001816 | CEACAM8 | carcinoembryonic antigen-related cell adhesion molecule 8 | Immunoglobulin domain, Antigen, Signal, Glycoprotein, GPI-anchor, Repeat, Polymorphism, Lipoprotein | 2141 | 6109 |
| NM_001817 | CEACAM4 | carcinoembryonic antigen-related cell adhesion molecule 4 | Antigen | 2142 | 6110 |
| NM_001828 | CLC | Charot-Leyden crystal protein | Hydrolase, Serine esterase, Lipid degradation, Galectin, Acetylation, 3D-structure, Polymorphism | 2143 | 6111 |
| NM_001835 | CLTCL1 | clathrin, heavy polypeptide-like 1 | Coated pits, Alternative splicing | 2144 | 6112 |
| NM_001838 | CCR7 | chemokine (C—C motif) receptor 7 | G-protein coupled receptor, Transmembrane, Glycoprotein, Signal | 2145 | 6113 |
| NM_001839 | CNN3 | calponin 3, acidic | Calmodulin-binding, Actin-binding, Multigene family, Repeat | 2146 | 6114 |
| NM_001853 | COL9A3 | collagen, type IX, alpha 3 | Hypothetical protein, Collagen, Extracellular matrix, Connective tissue, Repeat, Hydroxylation, Glycoprotein, Signal, Polymorphism | 2147 | 6115 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_001882 | CRHBP | corticotropin releasing hormone binding protein | Glycoprotein, Signal | 2148 | 6116 |
| NM_001889 | CRYZ | crystallin, zeta (quinone reductase) | Oxidoreductase, NADP, Zinc | 2149 | 6117 |
| NM_001894 | CSNK1E | casein kinase 1, epsilon | Transferase, Serine/threonine-protein kinase, ATP-binding, Phosphorylation, Multigene family | 2150 | 6118 |
| NM_001907 | CTRL | chymotrypsin-like | Hydrolase, Protease, Serine protease, Transferase, Serine/threonine-protein kinase, ATP-binding, Phosphorylation, Golgi stack, Nuclear protein, Glycoprotein, Zymogen, Signal | 2151 | 6119 |
| NM_001909 | CTSD | cathepsin D (lysosomal aspartyl protease) | Hydrolase, Aspartyl protease, Glycoprotein, Lysosome, Signal, Zymogen, Polymorphism, Alzheimer's disease, 3D-structure | 2152 | 6120 |
| NM_001911 | CTSG | cathepsin G | Hydrolase, Serine protease, Zymogen, Glycoprotein, Signal, Polymorphism, 3D-structure | 2153 | 6121 |
| NM_001921 | DCTD | dCMP deaminase | Hydrolase, Allosteric enzyme, Nucleotide biosynthesis, Zinc | 2154 | 6122 |
| NM_001925 | DEFA4 | defensin, alpha 4, corticostatin | Defensin, Antibiotic, Fungicide, Signal | 2155 | 6123 |
| NM_001939 | DRP2 | dystrophin related protein 2 | Structural protein, Cytoskeleton, Repeat, Zinc-finger | 2156 | 6124 |
| NM_001940 | DRPLA | dentatorubral-pallidoluysian atrophy (atrophin-1) | Triplet repeat expansion, Polymorphism, Epilepsy | 2157 | 6125 |
| NM_001946 | DUSP6 | dual specificity phosphatase 6 | Hydrolase, Polymorphism, Alternative splicing, 3D-structure | 2158 | 6126 |
| NM_001951 | E2F5 | E2F transcription factor 5, p130-binding | Transcription regulation, Activator, DNA-binding, Nuclear protein, Polymorphism | 2159 | 6127 |
| NM_001953 | ECGF1 | endothelial cell growth factor 1 (platelet-derived) | Transferase, Glycosyltransferase, Growth factor, Chemotaxis, Angiogenesis, Repeat, Polymorphism, Disease mutation | 2160 | 6128 |
| NM_001964 | EGR1 | early growth response 1 | Transcription regulation, Activator, DNA-binding, Nuclear protein, Repeat, Zinc-finger, Metal-binding | 2161 | 6129 |
| NM_001965 | EGR4 | early growth response 4 | Nuclear protein, Transcription regulation, DNA-binding, Zinc-finger, Metal-binding, Repeat | 2162 | 6130 |
| NM_001970 | EIF5A | eukaryotic translation initiation factor 5A | Protein biosynthesis, Initiation factor, Hypusine, 3D-structure | 2163 | 6131 |
| NM_001972 | ELA2 | elastase 2, neutrophil | Hydrolase, Serine protease, Glycoprotein, Signal, 3D-structure, Disease mutation | 2164 | 6132 |
| NM_001992 | F2R | coagulation factor II (thrombin) receptor | G-protein coupled receptor, Transmembrane, Glycoprotein, Signal, Blood coagulation, Phosphorylation, Polymorphism, 3D-structure, Receptor | 2165 | 6133 |
| NM_001995 | FACL1 | fatty-acid-Coenzyme A ligase, long-chain 2 | Ligase, Fatty acid metabolism, Magnesium, Multigene family, Hypothetical protein | 2166 | 6134 |
| NM_001996 | FBLN1 | fibulin 1 | Signal, Alternative splicing, Glycoprotein, Extracellular matrix, Repeat, EGF-like domain, Calcium-binding, Chromosomal translocation, Polymorphism, Hypothetical protein | 2167 | 6135 |
| NM_001999 | FBN2 | fibrillin 2 (congenital contractural arachnodactyly) | Hypothetical protein, EGF-like domain, Extracellular matrix, Calcium-binding, Glycoprotein, Repeat, Signal, Multigene family, Disease mutation, Polymorphism | 2168 | 6136 |
| NM_002000 | FCAR | Fc fragment of IgA, receptor for | Receptor, Glycoprotein, Transmembrane, IgA-binding protein, Immunoglobulin domain, Repeat, Signal, Alternative splicing | 2169 | 6137 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002003 | FCN1 | ficolin (collagen/fibrinogen domain containing) 1 | Lectin, Collagen, Repeat, Glycoprotein, Signal, Multigene family | 2170 | 6138 |
| NM_002005 | FES | feline sarcoma oncogene | Transferase, Tyrosine-protein kinase, Proto-oncogene, ATP-binding, Phosphorylation, SH2 domain | 2171 | 6139 |
| NM_002010 | FGF9 | fibroblast growth factor 9 (glia-activating factor) | Growth factor, Differentiation, Mitogen, Heparin-binding, Glycoprotein, 3D-structure | 2172 | 6140 |
| NM_002013 | FKBP3 | FK506 binding protein 3, 25 kDa | Isomerase, Rotamase, Nuclear protein, 3D-structure | 2173 | 6141 |
| NM_002014 | FKBP4 | FK506 binding protein 4, 59 kDa | Isomerase, Rotamase, Repeat, TPR repeat, Nuclear protein, Phosphorylation, 3D-structure | 2174 | 6142 |
| NM_002017 | FLI1 | Friend leukemia virus integration 1 | Transcription regulation, Activator, DNA-binding, Nuclear protein, Alternative splicing, Proto-oncogene, Chromosomal translocation, 3D-structure | 2175 | 6143 |
| NM_002018 | FLII | flightless I homolog (*Drosophila*) | Developmental protein, Repeat, Leucine-rich repeat | 2176 | 6144 |
| NM_002029 | FPR1 | formyl peptide receptor 1 | G-protein coupled receptor, Transmembrane, Glycoprotein, Chemotaxis, Polymorphism | 2177 | 6145 |
| NM_002032 | FTH1 | ferritin, heavy polypeptide 1 | Transport, Ion transport, Ionic channel, Chloride channel, Chloride, Calcium, Alternative splicing, Disease mutation, Polymorphism, Vision, Transmembrane, Phosphorylation, Iron storage, Metal-binding, 3D-structure | 2178 | 6146 |
| NM_002033 | FUT4 | fucosyltransferase 4 (alpha (1, 3) fucosyltransferase, myeloid-specific) | Transferase, Glycosyltransferase, Transmembrane, Glycoprotein, Signal-anchor, Golgi stack | 2179 | 6147 |
| NM_002035 | FVT1 | follicular lymphoma variant translocation 1 | Proto-oncogene, Chromosomal translocation, Oxidoreductase, Signal | 2180 | 6148 |
| NM_002037 | FYN | FYN oncogene related to SRC, FGR, YES | Hypothetical protein, ATP-binding, SH3 domain, Transferase, Kinase, Tyrosine-protein kinase, Proto-oncogene, Phosphorylation, Myristate, SH2 domain, Palmitate, Lipoprotein, 3D-structure, Polymorphism | 2181 | 6149 |
| NM_002046 | GAPD | glyceraldehyde-3-phosphate dehydrogenase | Glycolysis, NAD, Oxidoreductase, Multigene family | 2182 | 6150 |
| NM_002051 | GATA3 | GATA binding protein 3 | Hypothetical protein, Transcription regulation, Activator, DNA-binding, Zinc-finger, Nuclear protein, T-cell, Alternative splicing | 2183 | 6151 |
| NM_002061 | GCLM | glutamate-cysteine ligase, modifier subunit | Ligase, Glutathione biosynthesis | 2184 | 6152 |
| NM_002064 | GLRX | glutaredoxin (thioltransferase) | Redox-active center, Electron transport, Acetylation, Polymorphism, 3D-structure | 2185 | 6153 |
| NM_002068 | GNA15 | guanine nucleotide binding protein (G protein), alpha 15 (Gq class) | GTP-binding, Transducer, Multigene family, ADP-ribosylation | 2186 | 6154 |
| NM_002069 | GNAI1 | guanine nucleotide binding protein (G protein), alpha inhibiting activity polypeptide 1 | Hypothetical protein, GTP-binding, Transducer, ADP-ribosylation, Multigene family, Myristate, Palmitate, Lipoprotein, 3D-structure | 2187 | 6155 |
| NM_002070 | GNAI2 | guanine nucleotide binding protein (G protein), alpha inhibiting activity polypeptide 2 | GTP-binding, Transducer, ADP-ribosylation, Multigene family, Myristate, Palmitate, Lipoprotein | 2188 | 6156 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002073 | GNAZ | guanine nucleotide binding protein (G protein), alpha z polypeptide | GTP-binding, Transducer, ADP-ribosylation, Multigene family, Lipoprotein, Palmitate, Myristate, Membrane | 2189 | 6157 |
| NM_002081 | GPC1 | glypican 1 | Proteoglycan, Heparan sulfate, Glycoprotein, Signal, GPI-anchor, Lipoprotein | 2190 | 6158 |
| NM_002082 | GPRK6 | G protein-coupled receptor kinase 6 | Transferase, Serine/threonine-protein kinase, ATP-binding, Phosphorylation, Lipoprotein, Palmitate, Alternative splicing, Kinase, Receptor, Hypothetical protein | 2191 | 6159 |
| NM_002086 | GRB2 | growth factor receptor-bound protein 2 | SH2 domain, SH3 domain, Repeat, Alternative splicing, 3D-structure | 2192 | 6160 |
| NM_002087 | GRN | granulin | Cytokine, Repeat, Glycoprotein, Signal, Alternative splicing, Polymorphism, 3D-structure, Hypothetical protein | 2193 | 6161 |
| NM_002092 | GRSF1 | G-rich RNA sequence binding factor 1 | Hypothetical protein, RNA-binding, Repeat | 2194 | 6162 |
| NM_002093 | GSK3B | glycogen synthase kinase 3 beta | Transferase, Serine/threonine-protein kinase, ATP-binding, Wnt signaling pathway, Phosphorylation, Multigene family, Alternative splicing, 3D-structure | 2195 | 6163 |
| NM_002096 | GTF2F1 | general transcription factor IIF, polypeptide 1, 74 kDa | Transcription regulation, DNA-binding, Nuclear protein, Phosphorylation, 3D-structure | 2196 | 6164 |
| NM_002097 | GTF3A | general transcription factor IIIA | Transcription regulation, Zinc-finger, Metal-binding, DNA-binding, RNA-binding, Repeat, Nuclear protein, Polymorphism, Initiation factor | 2197 | 6165 |
| NM_002103 | GYS1 | glycogen synthase 1 (muscle) | Glycogen biosynthesis, Transferase, Glycosyltransferase, Allosteric enzyme, Phosphorylation, Disease mutation, Diabetes mellitus, Polymorphism, Hypothetical protein | 2198 | 6166 |
| NM_002104 | GZMK | granzyme K (serine protease, granzyme 3; tryptase II) | Hydrolase, Serine protease, Zymogen, Signal, 3D-structure | 2199 | 6167 |
| NM_002105 | H2AFX | H2A histone family, member X | Chromosomal protein, Nucleosome core, Nuclear protein, DNA-binding, Multigene family, Acetylation | 2200 | 6168 |
| NM_002107 | H3F3A | H3 histone, family 3A | Nuclear protein, Chromosomal protein, DNA-binding, Nucleosome core, Multigene family | 2201 | 6169 |
| NM_002108 | HAL | histidine ammonia-lyase | Lyase, Histidine metabolism, Polymorphism | 2202 | 6170 |
| NM_002109 | HARS | histidyl-tRNA synthetase | Aminoacyl-tRNA synthetase, Protein biosynthesis, Ligase, ATP-binding, Hypothetical protein, Repeat, WD repeat | 2203 | 6171 |
| NM_002110 | HCK | hemopoietic cell kinase | Transferase, Tyrosine-protein kinase, Phosphorylation, ATP-binding, Lipoprotein, Myristate, Palmitate, SH2 domain, SH3 domain, Alternative initiation, 3D-structure | 2204 | 6172 |
| NM_002115 | HK3 | hexokinase 3 (white cell) | Kinase, Transferase, Glycolysis, Allosteric enzyme, Repeat, ATP-binding, Membrane | 2205 | 6173 |
| NM_002131 | HMGA1 | high mobility group AT-hook 1 | Nuclear protein, Chromosomal protein, DNA-binding, Repeat, Transcription regulation, Alternative splicing, Phosphorylation, Acetylation, Chromosomal translocation, 3D-structure | 2206 | 6174 |
| NM_002133 | HMOX1 | heme oxygenase (decycling) 1 | Cyclin, Heme, Oxidoreductase, Microsome, Multigene family, 3D-structure | 2207 | 6175 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002134 | HMOX2 | heme oxygenase (decycling) 2 | Heme, Oxidoreductase, Microsome, Multigene family, Repeat | 2208 | 6176 |
| NM_002136 | HNRPA1 | heterogeneous nuclear ribonucleoprotein A1 | Hypothetical protein, Nucleocapsid, Ribonucleoprotein, Nuclear protein, RNA-binding, Repeat, Methylation, Alternative splicing, 3D-structure, Polymorphism | 2209 | 6177 |
| NM_002139 | RBMX | RNA binding motif protein, X-linked | Hypothetical protein, Nuclear protein, RNA-binding, Ribonucleoprotein, Glycoprotein | 2210 | 6178 |
| NM_002155 | HSPA6 | heat shock 70 kDa protein 6 (HSP70B') | ATP-binding, Heat shock, Multigene family | 2211 | 6179 |
| NM_002156 | HSPD1 | heat shock 60 kDa protein 1 (chaperonin) | Chaperone, ATP-binding, Mitochondrion, Transit peptide | 2212 | 6180 |
| NM_002157 | HSPE1 | heat shock 10 kDa protein 1 (chaperonin 10) | Chaperone, Mitochondrion, Heat shock, Acetylation | 2213 | 6181 |
| NM_002162 | ICAM3 | intercellular adhesion molecule 3 | Immunoglobulin domain, Cell adhesion, Glycoprotein, Transmembrane, Repeat, Signal, Phosphorylation | 2214 | 6182 |
| NM_002180 | IGHMBP2 | immunoglobulin mu binding protein 2 | Hydrolase, Helicase, ATP-binding, DNA-binding, Nuclear protein, Transcription regulation, Activator, 3D-structure | 2215 | 6183 |
| NM_002191 | INHA | inhibin, alpha | Growth factor, Hormone, Glycoprotein, Signal, Polymorphism | 2216 | 6184 |
| NM_002194 | INPP1 | inositol polyphosphate-1-phosphatase | Hydrolase, Lithium | 2217 | 6185 |
| NM_002205 | ITGA5 | integrin, alpha 5 (fibronectin receptor, alpha polypeptide) | Integrin, Cell adhesion, Receptor, Glycoprotein, Transmembrane, Signal, Calcium, Repeat | 2218 | 6186 |
| NM_002209 | ITGAL | integrin, alpha L (antigen CD11A (p180), lymphocyte function-associated antigen 1; alpha polypeptide) | Integrin, Cell adhesion, Receptor, Glycoprotein, Transmembrane, Signal, 3D-structure, Magnesium, Calcium, Repeat, Alternative splicing, Hypothetical protein | 2219 | 6187 |
| NM_002218 | ITIH4 | inter-alpha (globulin) inhibitor H4 (plasma Kallikrein-sensitive glycoprotein) | Acute phase, Serine protease inhibitor, Repeat, Signal, Multigene family, Glycoprotein, Alternative splicing, Polymorphism | 2220 | 6188 |
| NM_002220 | ITPKA | inositol 1,4,5-trisphosphate 3-kinase A | Kinase, Transferase, Calmodulin-binding | 2221 | 6189 |
| NM_002222 | ITPR1 | inositol 1,4,5-triphosphate receptor, type 1 | Receptor, Transmembrane, Phosphorylation, Endoplasmic reticulum, Ionic channel, Ion transport, Calcium channel, Alternative splicing, Repeat | 2222 | 6190 |
| NM_002226 | JAG2 | jagged 2 | Calcium-binding, EGF-like domain, Glycoprotein, Developmental protein, Repeat, Signal, Transmembrane, Alternative splicing | 2223 | 6191 |
| NM_002228 | JUN | v-jun sarcoma virus 17 oncogene homolog (avian) | Proto-oncogene, Transcription regulation, DNA-binding, 3D-structure, Nuclear protein, Phosphorylation, Polymorphism | 2224 | 6192 |
| NM_002236 | KCNF1 | potassium voltage-gated channel, subfamily F, member 1 | Transport, Ion transport, Ionic channel, Voltage-gated channel, Potassium channel, Potassium, Potassium transport, Transmembrane, Multigene family | 2225 | 6193 |
| NM_002243 | KCNJ15 | potassium inwardly-rectifying channel, subfamily J, member 15 | Hypothetical protein, Ionic channel, Ion transport, Voltage-gated channel, Transmembrane, Potassium transport | 2226 | 6194 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002250 | KCNN4 | potassium intermediate/small conductance calcium-activated channel, subfamily N, member 4 | Ionic channel, Transmembrane, Ion transport, Calmodulin-binding | 2227 | 6195 |
| NM_002258 | KLRB1 | killer cell lectin-like receptor subfamily B, member 1 | | 2228 | 6196 |
| NM_002267 | KPNA3 | karyopherin alpha 3 (importin alpha 4) | Hypothetical protein, Transport, Protein transport, Repeat, Nuclear protein, Polymorphism | 2229 | 6197 |
| NM_002271 | KPNB3 | karyopherin (importin) beta 3 | Hypothetical protein, Transport, Protein transport, Repeat, Nuclear protein, Polymorphism | 2230 | 6198 |
| NM_002273 | KRT8 | keratin 8 | Intermediate filament, Coiled coil, Keratin, Phosphorylation | 2231 | 6199 |
| NM_002275 | KRT15 | keratin 15 | Intermediate filament, Coiled coil, Keratin | 2232 | 6200 |
| NM_002277 | KRTHA1 | keratin, hair, acidic, 1 | Intermediate filament, Coiled coil, Keratin | 2233 | 6201 |
| NM_002278 | KRTHA2 | keratin, hair, acidic, 2 | Intermediate filament, Coiled coil, Keratin | 2234 | 6202 |
| NM_002282 | KRTHB3 | keratin, hair, basic, 3 | Coiled coil, Intermediate filament | 2235 | 6203 |
| NM_002296 | LBR | lamin B receptor | Receptor, Transmembrane, Phosphorylation, Nuclear protein, DNA-binding | 2236 | 6204 |
| NM_002298 | LCP1 | lymphocyte cytosolic protein 1 (L-plastin) | Calcium-binding, Phosphorylation, Actin-binding, Repeat, Polymorphism | 2237 | 6205 |
| NM_002299 | LCT | lactase | Hydrolase, Glycosidase, Zymogen, Signal, Transmembrane, Repeat | 2238 | 6206 |
| NM_002300 | LDHB | lactate dehydrogenase B | Oxidoreductase, NAD, Glycolysis, Multigene family, Disease mutation, 3D-structure | 2239 | 6207 |
| NM_002306 | LGALS3 | lectin, galactoside-binding, soluble, 3 (galectin 3) | Galectin, Lectin, IgE-binding protein, Repeat, Phosphorylation, Acetylation, Nuclear protein, Polymorphism, 3D-structure | 2240 | 6208 |
| NM_002311 | LIG3 | ligase III, DNA, ATP-dependent | DNA repair, DNA replication, DNA recombination, Cell division, Ligase, ATP-binding, Zinc-finger, Nuclear protein, Alternative splicing, 3D-structure, Hypothetical protein | 2241 | 6209 |
| NM_002313 | ABLIM1 | actin binding LIM protein 1 | LIM domain, Metal-binding, Zinc, Hypothetical protein | 2242 | 6210 |
| NM_002316 | LMX1B | LIM homeobox transcription factor 1, beta | DNA-binding, Homeobox, LIM domain, Metal-binding, Nuclear protein, Zinc, Developmental protein, Repeat, Activator, Transcription regulation, Alternative splicing, Disease mutation | 2243 | 6211 |
| NM_002332 | LRP1 | low density lipoprotein-related protein 1 (alpha-2-macroglobulin receptor) | Receptor, Transmembrane, Repeat, Endocytosis, Glycoprotein, Signal, Calcium-binding, EGF-like domain, Coated pits, 3D-structure, Polymorphism | 2244 | 6212 |
| NM_002335 | LRP5 | low density lipoprotein receptor-related protein 5 | Receptor, Lipoprotein | 2245 | 6213 |
| NM_002337 | LRPAP1 | low density lipoprotein receptor-related protein associated protein 1 | Signal, Heparin-binding, Glycoprotein, Antigen, 3D-structure, Polymorphism | 2246 | 6214 |
| NM_002339 | LSP1 | lymphocyte-specific protein 1 | T-cell, Phosphorylation, Polymorphism | 2247 | 6215 |
| NM_002341 | LTB | lymphotoxin beta (TNF superfamily, member 3) | Cytokine, Transmembrane, Glycoprotein, Signal-anchor, Alternative splicing, Polymorphism | 2248 | 6216 |
| NM_002343 | LTF | lactotransferrin | Glycoprotein, Iron transport, Metal-binding, Transport, Repeat, Signal, Polymorphism, 3D-structure | 2249 | 6217 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002357 | MAD | MAX dimerization protein 1 | Nuclear protein, DNA-binding, Transcription regulation, Repressor, 3D-structure | 2250 | 6218 |
| NM_002375 | MAP4 | microtubule-associated protein 4 | Hypothetical protein, Microtubule, Repeat, Phosphorylation, Alternative splicing | 2251 | 6219 |
| NM_002382 | MAX | MAX protein | Hypothetical protein, Transcription regulation, Activator, Repressor, Nuclear protein, DNA-binding, Phosphorylation, Alternative splicing, 3D-structure | 2252 | 6220 |
| NM_002394 | SLC3A2 | solute carrier family 3 (activators of dibasic and neutral amino acid transport), member 2 | Glycoprotein, Transmembrane, Signal-anchor | 2253 | 6221 |
| NM_002402 | MEST | mesoderm specific transcript homolog (mouse) | Aromatic hydrocarbons catabolism, Detoxification, Hydrolase, Hypothetical protein | 2254 | 6222 |
| NM_002406 | MGAT1 | mannosyl (alpha-1,3-)-glycoprotein beta-1,2-N-acetylglucosaminyltransferase | Transferase, Glycosyltransferase, Transmembrane, Signal-anchor, Golgi stack, Hypothetical protein | 2255 | 6223 |
| NM_002419 | MAP3K11 | mitogen-activated protein kinase kinase kinase 11 | ATP-binding, Kinase, SH3 domain, Serine/threonine-protein kinase, Transferase | 2256 | 6224 |
| NM_002424 | MMP8 | matrix metalloproteinase 8 (neutrophil collagenase) | Hydrolase, Metalloprotease, Glycoprotein, Calcium-binding, Metal-binding, Zinc, Zymogen, Collagen degradation, Extracellular matrix, Signal, 3D-structure | 2257 | 6225 |
| NM_002431 | MNAT1 | menage a trois 1 (CAK assembly factor) | Transcription regulation, Cell cycle, Nuclear protein, Zinc-finger, 3D-structure | 2258 | 6226 |
| NM_002432 | MNDA | myeloid cell nuclear differentiation antigen | Interferon induction, Nuclear protein, DNA-binding, Transcription regulation, Activator, Repressor, Polymorphism | 2259 | 6227 |
| NM_002435 | MPI | mannose phosphate isomerase | Isomerase, Zinc, Disease mutation | 2260 | 6228 |
| NM_002442 | MSI1 | musashi homolog 1 (Drosophila) | RNA-binding | 2261 | 6229 |
| NM_002453 | MTIF2 | mitochondrial translational initiation factor 2 | Initiation factor, Protein biosynthesis, GTP-binding, Transit peptide, Mitochondrion, Polymorphism | 2262 | 6230 |
| NM_002455 | MTX1 | metaxin 1 | Mitochondrion, Outer membrane, Transmembrane, Transport, Protein transport | 2263 | 6231 |
| NM_002475 | MLC1SA | myosin light chain 1 slow a | Myosin, Muscle protein, Multigene family | 2264 | 6232 |
| NM_002483 | CEACAM6 | carcinoembryonic antigen-related cell adhesion molecule 6 (non-specific cross reacting antigen) | Immunoglobulin domain, Signal, Antigen, Glycoprotein, GPI-anchor, Repeat, Lipoprotein | 2265 | 6233 |
| NM_002486 | NCBP1 | nuclear cap binding protein subunit 1, 80 kDa | Transport, mRNA transport, Nuclear protein, RNA-binding, 3D-structure | 2266 | 6234 |
| NM_002492 | NDUFB5 | NADH dehydrogenase (ubiquinone) 1 beta subcomplex, 5, 16 kDa | Oxidoreductase, NAD, Ubiquinone, Mitochondrion, Transit peptide | 2267 | 6235 |
| NM_002495 | NDUFS4 | NADH dehydrogenase (ubiquinone) Fe—S protein 4, 18 kDa (NADH-coenzyme Q reductase) | Oxidoreductase, NAD, Ubiquinone, Mitochondrion, Transit peptide, Polymorphism | 2268 | 6236 |
| NM_002499 | NEO1 | neogenin homolog 1 (chicken) | Cell adhesion, Repeat, Signal, Transmembrane, Immunoglobulin domain, Glycoprotein, Alternative splicing | 2269 | 6237 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002512 | NME2 | non-metastatic cells 2, protein (NM23B) expressed in | Transferase, Kinase, ATP-binding, Nuclear protein, Anti-oncogene DNA-binding, Transcription regulation, Activator, 3D-structure | 2270 | 6238 |
| NM_002517 | NPAS1 | neuronal PAS domain protein 1 | Repeat, DNA-binding, Nuclear protein, Transcription regulation | 2271 | 6239 |
| NM_002520 | NPM1 | nucleophosmin (nucleolar phosphoprotein B23, numatrin) | Hypothetical protein, Transcription regulation, Nuclear protein, DNA-binding, Zinc-finger, Proto-oncogene, Chromosomal translocation, Alternative splicing, Repeat, Coiled coil, 3D-structure, Metal-binding, Receptor, Multigene family, Phosphorylation, RNA- | 2272 | 6240 |
| NM_002524 | NRAS | neuroblastoma RAS viral (v-ras) oncogene homolog | Hypothetical protein, RNA-binding, Repeat, Alternative splicing, Proto-oncogene, GTP-binding, Prenylation, Lipoprotein, Disease mutation | 2273 | 6241 |
| NM_002528 | NTHL1 | nth endonuclease III-like 1 (*E. coli*) | Hydrolase, Nuclease, Endonuclease, Multifunctional enzyme, DNA repair, Glycosidase, Lyase, Iron-sulfur, 4Fe—4S, Nuclear protein, Polymorphism | 2274 | 6242 |
| NM_002532 | NUP88 | nucleoporin 88 kDa | Nuclear protein, Transport, Coiled coil | 2275 | 6243 |
| NM_002541 | OGDH | oxoglutarate (alpha-ketoglutarate) dehydrogenase (lipoamide) | Glycolysis, Oxidoreductase, Flavoprotein, Thiamine pyrophosphate, Mitochondrion, Transit peptide, Hypothetical protein | 2276 | 6244 |
| NM_002543 | OLR1 | oxidised low density lipoprotein (lectin-like) receptor 1 | Lectin, Lipoprotein, Receptor | 2277 | 6245 |
| NM_002553 | ORC5L | origin recognition complex, subunit 5-like (yeast) | DNA replication, Nuclear protein, ATP-binding, Polymorphism | 2278 | 6246 |
| NM_002555 | SLC22A1L | solute carrier family 22 (organic cation transporter), member 1-like | Hypothetical protein | 2279 | 6247 |
| NM_002557 | OVGP1 | oviductal glycoprotein 1, 120 kDa (mucin 9, oviductin) | Glycoprotein, Fertilization, Signal, Polymorphism | 2280 | 6248 |
| NM_002564 | P2RY2 | purinergic receptor P2Y, G-protein coupled, 2 | G-protein coupled receptor, Transmembrane, Glycoprotein | 2281 | 6249 |
| NM_002573 | PAFAH1B3 | platelet-activating factor acetylhydrolase, isoform Ib, gamma subunit 29 kDa | Hydrolase, Lipid degradation | 2282 | 6250 |
| NM_002574 | PRDX1 | peroxiredoxin 1 | Antioxidant, Peroxidase, Oxidoreductase, Redox-active center | 2283 | 6251 |
| NM_002576 | PAK1 | p21/Cdc42/Rac1-activated kinase 1 (STE20 homolog, yeast) | Apoptosis, Transferase, Serine/threonine-protein kinase, ATP-binding, Phosphorylation, 3D-structure, Kinase | 2284 | 6252 |
| NM_002585 | PBX1 | pre-B-cell leukemia transcription factor 1 | Transcription regulation, DNA-binding, Nuclear protein, Activator, Repressor, Homeobox, Proto-oncogene, Chromosomal translocation, Alternative splicing, Steroidogenesis, Sexual differentiation, 3D-structure, Phosphorylation | 2285 | 6253 |
| NM_002587 | PCDH1 | protocadherin 1 (cadherin-like 1) | Cell adhesion, Transmembrane, Calcium-binding, Repeat, Signal, Alternative splicing | 2286 | 6254 |
| NM_002598 | PDCD2 | programmed cell death 2 | Zinc-finger, DNA-binding, Nuclear protein, Apoptosis | 2287 | 6255 |
| NM_002601 | PDE6D | phosphodiesterase 6D, cGMP-specific, rod, delta | Hydrolase, cGMP, Vision, 3D-structure | 2288 | 6256 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002608 | PDGFB | platelet-derived growth factor beta polypeptide (simian sarcoma viral (v-sis) oncogene homolog) | Mitogen, Growth factor, Proto-oncogene, Platelet, Signal, Pharmaceutical, 3D-structure, Polymorphism, Chromosomal translocation | 2289 | 6257 |
| NM_002611 | PDK2 | pyruvate dehydrogenase kinase, isoenzyme 2 | Kinase, Transferase, Transit peptide, Mitochondrion, Multigene family | 2290 | 6258 |
| NM_002613 | PDPK1 | 3-phosphoinositide dependent protein kinase-1 | Transferase, Serine/threonine-protein kinase, ATP-binding, Phosphorylation, Membrane, Alternative splicing, Kinase | 2291 | 6259 |
| NM_002616 | PER1 | period homolog 1 (Drosophila) | Transcription regulation, Nuclear protein, Repeat, Biological rhythms, Alternative splicing | 2292 | 6260 |
| NM_002621 | PFC | properdin P factor, complement | Signal, Complement alternate pathway, Glycoprotein, Repeat, Disease mutation | 2293 | 6261 |
| NM_002629 | PGAM1 | phosphoglycerate mutase 1 (brain) | Isomerase, Hydrolase, Glycolysis, Acetylation, 3D-structure | 2294 | 6262 |
| NM_002631 | PGD | phosphogluconate dehydrogenase | Oxidoreductase, Pentose shunt, NADP | 2295 | 6263 |
| NM_002633 | PGM1 | phosphoglucomutase 1 | Isomerase, Phosphorylation, Magnesium, Polymorphism, Alternative splicing, Hypothetical protein | 2296 | 6264 |
| NM_002635 | SLC25A3 | solute carrier family 25 (mitochondrial carrier; phosphate carrier), member 3 | Mitochondrion, Inner membrane, Repeat, Transit peptide, Transmembrane, Transport, Symport, Alternative splicing, Hypothetical protein | 2297 | 6265 |
| NM_002640 | SERPINB8 | serine (or cysteine) proteinase inhibitor, clade B (ovalbumin), member 8 | Protease inhibitor, Serine protease inhibitor, Serpin | 2298 | 6266 |
| NM_002649 | PIK3CG | phosphoinositide-3-kinase, catalytic, gamma polypeptide | Kinase, Transferase, Multigene family, 3D-structure | 2299 | 6267 |
| NM_002650 | PIK4CA | phosphatidylinositol 4-kinase, catalytic, alpha polypeptide | Transferase, Kinase, Alternative splicing | 2300 | 6268 |
| NM_002651 | PIK4CB | phosphatidylinositol 4-kinase, catalytic, beta polypeptide | Transferase, Kinase, Golgi stack, Phosphorylation, Alternative splicing | 2301 | 6269 |
| NM_002653 | PITX1 | paired-like homeodomain transcription factor 1 | Homeobox, DNA-binding, Developmental protein, Nuclear protein, Transcription regulation, Activator | 2302 | 6270 |
| NM_002654 | PKM2 | pyruvate kinase, muscle | Transferase, Kinase, Glycolysis, Multigene family, Magnesium, Alternative splicing, Hypothetical protein | 2303 | 6271 |
| NM_002655 | PLAG1 | pleiomorphic adenoma gene 1 | Metal-binding, Zinc, Zinc-finger | 2304 | 6272 |
| NM_002659 | PLAUR | plasminogen activator, urokinase receptor | Receptor, Signal, Glycoprotein, GPI-anchor, Repeat, Alternative splicing, Polymorphism, Lipoprotein, Kinase | 2305 | 6273 |
| NM_002661 | PLCG2 | phospholipase C, gamma 2 (phosphatidylinositol specific) | Hydrolase, Lipid degradation, Transducer, SH2 domain, SH3 domain, Repeat, Calcium-binding, Phosphorylation | 2306 | 6274 |
| NM_002668 | PLP2 | proteolipid protein 2 (colonic epithelium-enriched) | Transmembrane, Glycoprotein, Polymorphism | 2307 | 6275 |
| NM_002676 | PMM1 | phosphomannomutase 1 | Isomerase | 2308 | 6276 |
| NM_002685 | PMSCL2 | polymyositis/scleroderma autoantigen 2, 100 kDa | Hydrolase, Nuclease, Exonuclease, rRNA processing, Nuclear protein, RNA-binding, Antigen, Alternative splicing, Hypothetical protein | 2309 | 6277 |
| NM_002686 | PNMT | phenylethanolamine N-methyltransferase | Transferase, Methyltransferase, Catecholamine biosynthesis, 3D-structure | 2310 | 6278 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002688 | PNUTL1 | peanut-like 1 (*Drosophila*) | Hypothetical protein, Cell division, GTP-binding, Coiled coil, Platelet, Transmembrane, Glycoprotein, Hemostasis, Blood coagulation, Signal, Phosphorylation, Cell adhesion, Leucine-rich repeat | 2311 | 6279 |
| NM_002691 | POLD1 | polymerase (DNA directed), delta 1, catalytic subunit 125 kDa | DNA replication, DNA-binding, DNA-directed DNA polymerase, Transferase, Hydrolase, Exonuclease, Zinc-finger, Nuclear protein, Polymorphism | 2312 | 6280 |
| NM_002692 | POLE2 | polymerase (DNA directed), epsilon 2 (p59 subunit) | Transferase, DNA-directed DNA polymerase, DNA replication, DNA-binding, Nuclear protein | 2313 | 6281 |
| NM_002710 | PPP1CC | protein phosphatase 1, catalytic subunit, gamma isoform | Hydrolase, Metal-binding, Iron, Manganese, Glycogen metabolism, Multigene family, Cell division, Alternative splicing, 3D-structure | 2314 | 6282 |
| NM_002720 | PPP4C | protein phosphatase 4 (formerly X), catalytic subunit | Hydrolase, Metal-binding, Iron, Manganese | 2315 | 6283 |
| NM_002727 | PRG1 | proteoglycan 1, secretory granule | Glycoprotein, Proteoglycan, Repeat, Signal | 2316 | 6284 |
| NM_002728 | PRG2 | proteoglycan 2, bone marrow (natural killer cell activator, eosinophil granule major basic protein) | Eosinophil, Signal, Immune response, Antibiotic, Lectin, Proteoglycan, Glycoprotein, Heparin-binding, 3D-structure | 2317 | 6285 |
| NM_002731 | PRKACB | protein kinase, cAMP-dependent, catalytic, beta | ATP-binding, Kinase, Serine/threonine-protein kinase, Transferase, Nuclear protein, cAMP, Myristate, Phosphorylation, Multigene family, Lipoprotein | 2318 | 6286 |
| NM_002733 | PRKAG1 | protein kinase, AMP-activated, gamma 1 non-catalytic subunit | Fatty acid biosynthesis, Repeat, CBS domain, Hypothetical protein | 2319 | 6287 |
| NM_002738 | PRKCB1 | protein kinase C, beta 1 | Transferase, Serine/threonine-protein kinase, Membrane, ATP-binding, Calcium-binding, Metal-binding, Zinc, Repeat, Phorbol-ester binding, Phosphorylation, Alternative splicing | 2320 | 6288 |
| NM_002741 | PRKCL1 | protein kinase C-like 1 | Transferase, ATP-binding, Serine/threonine-protein kinase, Phosphorylation, Polymorphism, 3D-structure | 2321 | 6289 |
| NM_002745 | MAPK1 | mitogen-activated protein kinase 1 | Transferase, Serine/threonine-protein kinase, ATP-binding, Cell cycle, Phosphorylation, 3D-structure | 2322 | 6290 |
| NM_002748 | MAPK6 | mitogen-activated protein kinase 6 | Kinase, Transferase, Serine/threonine-protein kinase, ATP-binding, Cell cycle | 2323 | 6291 |
| NM_002749 | MAPK7 | mitogen-activated protein kinase 7 | ATP-binding, Kinase, Serine/threonine-protein kinase, Transferase, Cell cycle, Phosphorylation, Cell adhesion, Extracellular matrix, Glycoprotein, Calcium, Signal | 2324 | 6292 |
| NM_002756 | MAP2K3 | mitogen-activated protein kinase kinase 3 | Transferase, Serine/threonine-protein kinase, Tyrosine-protein kinase, ATP-binding, Phosphorylation, Alternative splicing, Disease mutation | 2325 | 6293 |
| NM_002757 | MAP2K5 | mitogen-activated protein kinase kinase 5 | ATP-binding, Kinase, Serine/threonine-protein kinase, Transferase | 2326 | 6294 |
| NM_002758 | MAP2K6 | mitogen-activated protein kinase kinase 6 | Transferase, Serine/threonine-protein kinase, Tyrosine-protein kinase, ATP-binding, Phosphorylation, Alternative splicing | 2327 | 6295 |
| NM_002764 | PRPS1 | phosphoribosyl pyrophosphate synthetase 1 | Nucleotide biosynthesis, Transferase, Kinase, Magnesium, Multigene family, Gout, Disease mutation | 2328 | 6296 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002765 | PRPS2 | phosphoribosyl pyrophosphate synthetase 2 | Nucleotide biosynthesis, Transferase, Kinase, Magnesium, Multigene family | 2329 | 6297 |
| NM_002767 | PRPSAP2 | phosphoribosyl pyrophosphate synthetase-associated protein 2 | Nucleotide biosynthesis | 2330 | 6298 |
| NM_002770 | PRSS2 | protease, serine, 2 (trypsin 2) | Hydrolase, Protease, Serine protease, Digestion, Pancreas, Zymogen, Calcium-binding, Signal, Multigene family | 2331 | 6299 |
| NM_002777 | PRTN3 | proteinase 3 (serine proteinase, neutrophil, Wegener granulomatosis autoantigen) | Collagen degradation, Hydrolase, Serine protease, Signal, Zymogen, Glycoprotein, Polymorphism, 3D-structure | 2332 | 6300 |
| NM_002782 | PSG6 | pregnancy specific beta-1-glycoprotein 6 | Immunoglobulin domain, Glycoprotein, Signal, Multigene family, Repeat, Polymorphism, Alternative splicing, Hypothetical protein, Flavoprotein, Lyase, Thiamine pyrophosphate | 2333 | 6301 |
| NM_002786 | PSMA1 | proteasome (prosome, macropain) subunit, alpha type, 1 | Proteasome, Hydrolase, Protease, Acetylation, Alternative splicing, Threonine protease | 2334 | 6302 |
| NM_002788 | PSMA3 | proteasome (prosome, macropain) subunit, alpha type, 3 | Proteasome, Hydrolase, Protease, Acetylation, Alternative splicing, Phosphorylation, Threonine protease | 2335 | 6303 |
| NM_002790 | PSMA5 | proteasome (prosome, macropain) subunit, alpha type, 5 | Proteasome, Hydrolase, Protease, Threonine protease | 2336 | 6304 |
| NM_002793 | PSMB1 | proteasome (prosome, macropain) subunit, beta type, 1 | Proteasome, Hydrolase, Protease, Threonine protease | 2337 | 6305 |
| NM_002794 | PSMB2 | proteasome (prosome, macropain) subunit, beta type, 2 | Proteasome, Hydrolase, Protease, Threonine protease | 2338 | 6306 |
| NM_002796 | PSMB4 | proteasome (prosome, macropain) subunit, beta type, 4 | Proteasome, Hydrolase, Protease, Zymogen, Polymorphism, Threonine protease | 2339 | 6307 |
| NM_002805 | PSMC5 | proteasome (prosome, macropain) 26S subunit, ATPase, 5 | ATP-binding, Proteasome | 2340 | 6308 |
| NM_002807 | PSMD1 | proteasome (prosome, macropain) 26S subunit, non-ATPase, 1 | Proteasome, Repeat | 2341 | 6309 |
| NM_002809 | PSMD3 | proteasome (prosome, macropain) 26S subunit, non-ATPase, 3 | Hypothetical protein, Proteasome | 2342 | 6310 |
| NM_002815 | PSMD11 | proteasome (prosome, macropain) 26S subunit, non-ATPase, 11 | Proteasome | 2343 | 6311 |
| NM_002818 | PSME2 | proteasome (prosome, macropain) activator subunit 2 (PA28 beta) | Proteasome, Interferon induction | 2344 | 6312 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002821 | PTK7 | PTK7 protein tyrosine kinase 7 | ATP-binding, Immunoglobulin domain, Receptor, Transferase, Transmembrane, Signal, Glycoprotein, Cell adhesion, Repeat, Hypothetical protein, Kinase, Tyrosine-protein kinase | 2345 | 6313 |
| NM_002824 | PTMS | parathymosin | Hypothetical protein, Immune response, Acetylation | 2346 | 6314 |
| NM_002826 | QSCN6 | quiescin Q6 | Redox-active center | 2347 | 6315 |
| NM_002831 | PTPN6 | protein tyrosine phosphatase, non-receptor type 6 | Hydrolase, SH2 domain, Repeat, Phosphorylation, Alternative splicing, 3D-structure | 2348 | 6316 |
| NM_002842 | PTPRH | protein tyrosine phosphatase, receptor type, H | Signal | 2349 | 6317 |
| NM_002843 | PTPRJ | protein tyrosine phosphatase, receptor type, J | Signal, Glycoprotein, Transmembrane, Repeat, Hydrolase, Disease mutation, Receptor | 2350 | 6318 |
| NM_002850 | PTPRS | protein tyrosine phosphatase, receptor type, S | Hydrolase, Receptor, Glycoprotein, Signal, Transmembrane, Cell adhesion, Immunoglobulin domain, Alternative splicing, Repeat | 2351 | 6319 |
| NM_002852 | PTX3 | pentaxin-related gene, rapidly induced by IL-1 beta | Pentaxin, Glycoprotein, Signal | 2352 | 6320 |
| NM_002859 | PXN | hypothetical protein FLJ23042 | Cytoskeleton, Phosphorylation, LIM domain, Repeat, Metal-binding, Zinc, Alternative splicing, 3D-structure, Hypothetical protein | 2353 | 6321 |
| NM_002862 | PYGB | phosphorylase, glycogen; brain | Carbohydrate metabolism, Glycosyltransferase, Pyridoxal phosphate, Transferase, Glycogen metabolism, Allosteric enzyme, Phosphorylation | 2354 | 6322 |
| NM_002863 | PYGL | phosphorylase, glycogen; liver (Hers disease, glycogen storage disease type VI) | Transferase, Glycosyltransferase, Carbohydrate metabolism, Glycogen metabolism, Allosteric enzyme, Pyridoxal phosphate, Phosphorylation, Glycogen storage disease, Disease mutation, Polymorphism, 3D-structure | 2355 | 6323 |
| NM_002865 | RAB2 | RAB2, member RAS oncogene family | GTP-binding, Transport, Protein transport, Endoplasmic reticulum, Golgi stack, Lipoprotein, Prenylation | 2356 | 6324 |
| NM_002872 | RAC2 | ras-related C3 botulinum toxin substrate 2 (rho family, small GTP binding protein Rac2) | GTP-binding, Prenylation, Lipoprotein, 3D-structure | 2357 | 6325 |
| NM_002878 | RAD51L3 | RAD51-like 3 (*S. cerevisiae*) | DNA damage, DNA repair, DNA recombination, DNA-binding, ATP-binding, Nuclear protein, Alternative splicing, Hypothetical protein | 2358 | 6326 |
| NM_002880 | RAF1 | v-raf-1 murine leukemia viral oncogene homolog 1 | Hypothetical protein, Metal-binding, Zinc, Zinc-finger, Transferase, Serine/threonine-protein kinase, Proto-oncogene, ATP-binding, Phorbol-ester binding, Phosphorylation, 3D-structure, Repeat | 2359 | 6327 |
| NM_002881 | RALB | v-ral simian leukemia viral oncogene homolog B (ras related; GTP binding protein) | GTP-binding, Prenylation, Lipoprotein | 2360 | 6328 |
| NM_002883 | RANGAP1 | Ran GTPase activating protein 1 | Hypothetical protein, GTPase activation, Repeat, Leucine-rich repeat, Ubl conjugation | 2361 | 6329 |
| NM_002887 | RARS | arginyl-tRNA synthetase | Aminoacyl-tRNA synthetase, Protein biosynthesis, Ligase, ATP-binding, Alternative initiation | 2362 | 6330 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002893 | RBBP7 | retinoblastoma binding protein 7 | Nuclear protein, Repeat, WD repeat | 2363 | 6331 |
| NM_002896 | RBM4 | RNA binding motif protein 4 | Zinc-finger | 2364 | 6332 |
| NM_002897 | RBMS1 | RNA binding motif, single stranded interacting protein 1 | DNA-binding, DNA replication, RNA-binding, Nuclear protein, Phosphorylation | 2365 | 6333 |
| NM_002901 | RCN1 | reticulocalbin 1, EF-hand calcium binding domain | Calcium-binding, Endoplasmic reticulum, Signal, Glycoprotein, Repeat, Polymorphism | 2366 | 6334 |
| NM_002902 | RCN2 | reticulocalbin 2, EF-hand calcium binding domain | Calcium-binding, Endoplasmic reticulum, Signal, Repeat | 2367 | 6335 |
| NM_002903 | RCV1 | recoverin | Calcium-binding, Repeat, Myristate, Vision, Lipoprotein | 2368 | 6336 |
| NM_002905 | RDH5 | retinol dehydrogenase 5 (11-cis and 9-cis) | Oxidoreductase, NAD, Membrane, Vision, Disease mutation, Polymorphism | 2369 | 6337 |
| NM_002910 | RENBP | renin binding protein | Isomerase | 2370 | 6338 |
| NM_002918 | RFX1 | regulatory factor X, 1 (influences HLA class II expression) | DNA-binding, Transcription regulation, Activator, Nuclear protein, 3D-structure | 2371 | 6339 |
| NM_002922 | RGS1 | regulator of G-protein signalling 1 | Signal transduction inhibitor, B-cell activation, Phosphorylation | 2372 | 6340 |
| NM_002923 | RGS2 | regulator of G-protein signalling 2, 24 kDa | Signal transduction inhibitor, Cell cycle, Phosphorylation | 2373 | 6341 |
| NM_002934 | RNASE2 | ribonuclease, RNase A family, 2 (liver, eosinophil-derived neurotoxin) | Hydrolase, Nuclease, Endonuclease, Chemotaxis, Eosinophil, Glycoprotein, Signal, Polymorphism, 3D-structure | 2374 | 6342 |
| NM_002935 | RNASE3 | ribonuclease, RNase A family, 3 (eosinophil cationic protein) | Hydrolase, Nuclease, Endonuclease, Eosinophil, Glycoprotein, Antibiotic, Signal, Polymorphism, 3D-structure | 2375 | 6343 |
| NM_002936 | RNASEH1 | ribonuclease H1 | Hydrolase, Nuclease, Endonuclease, Magnesium | 2376 | 6344 |
| NM_002939 | RNH | ribonuclease/angiogenin inhibitor | Repeat, Leucine-rich repeat, 3D-structure, Polymorphism, Hypothetical protein | 2377 | 6345 |
| NM_002940 | ABCE1 | ATP-binding cassette, sub-family E (OABP), member 1 | Capsid assembly, Chaperone, Mitochondrion, ATP-binding, Repeat | 2378 | 6346 |
| NM_002953 | RPS6KA1 | ribosomal protein S6 kinase, 90 kDa, polypeptide 1 | Transferase, Serine/threonine-protein kinase, ATP-binding, Repeat, Multigene family | 2379 | 6347 |
| NM_002957 | RXRA | retinoid X receptor, alpha | Receptor, Transcription regulation, DNA-binding, Nuclear protein, Zinc-finger, Multigene family, 3D-structure, Polymorphism | 2380 | 6348 |
| NM_002961 | S100A4 | S100 calcium binding protein A4 (calcium protein, calvasculin, metastasin, murine placental homolog) | Calcium-binding, 3D-structure | 2381 | 6349 |
| NM_002964 | S100A8 | S100 calcium binding protein A8 (calgranulin A) | Macrophage, Calcium-binding, 3D-structure | 2382 | 6350 |
| NM_002965 | S100A9 | S100 calcium binding protein A9 (calgranulin B) | Calcium-binding, Macrophage, Phosphorylation, Polymorphism, 3D-structure | 2383 | 6351 |
| NM_002967 | SAFB | scaffold attachment factor B | Transcription regulation, Repressor, Nuclear protein, DNA-binding, RNA-binding, Phosphorylation | 2384 | 6352 |
| NM_002969 | MAPK12 | mitogen-activated protein kinase 12 | Transferase, Serine/threonine-protein kinase, ATP-binding, Cell cycle, Phosphorylation, Polymorphism, 3D-structure | 2385 | 6353 |
| NM_002978 | SCNN1D | sodium channel, nonvoltage-gated 1, delta | Ion transport, Sodium transport, Ionic channel, Transmembrane, Glycoprotein, Alternative splicing, Sodium channel | 2386 | 6354 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_002984 | CCL4 | chemokine (C—C motif) ligand 4 | Cytokine, Chemotaxis, Inflammatory response, Signal, 3D-structure | 2387 | 6355 |
| NM_002985 | CCL5 | chemokine (C—C motif) ligand 5 | Cytokine, Chemotaxis, T-cell, Signal, Inflammatory response, 3D-structure | 2388 | 6356 |
| NM_003003 | SEC14L1 | SEC14-like 1 (*S. cerevisiae*) | | 2389 | 6357 |
| NM_003006 | SELPLG | selectin P ligand | Hypothetical protein, Cell adhesion, Glycoprotein, Transmembrane, Signal, Repeat, Polymorphism, Sulfation, 3D-structure, Lectin, Selectin | 2390 | 6358 |
| NM_003011 | SET | SET translocation (myeloid leukemia-associated) | Proto-oncogene, Chromosomal translocation, Nuclear protein, Phosphorylation | 2391 | 6359 |
| NM_003021 | SGT | small glutamine-rich tetratricopeptide repeat (TPR)-containing, alpha | Chaperone, Repeat, TPR repeat, Hypothetical protein | 2392 | 6360 |
| NM_003040 | SLC4A2 | solute carrier family 4, anion exchanger, member 2 (erythrocyte membrane protein band 3-like 1) | Transmembrane, Glycoprotein, Transport, Antiport, Ion transport, Anion exchange, Lipoprotein, Palmitate, Alternative splicing | 2393 | 6361 |
| NM_003044 | SLC6A12 | solute carrier family 6 (neurotransmitter transporter, betaine/GABA), member 12 | Neurotransmitter transport, Transport, Transmembrane, Glycoprotein, Symport | 2394 | 6362 |
| NM_003055 | SLC18A3 | choline acetyltransferase | Transport, Neurotransmitter transport, Transmembrane, Glycoprotein | 2395 | 6363 |
| NM_003056 | SLC19A1 | solute carrier family 19 (folate transporter), member 1 | Folate-binding, Transport, Transmembrane, Glycoprotein | 2396 | 6364 |
| NM_003057 | SLC22A1 | solute carrier family 22 (organic cation transporter), member 1 | Transmembrane | 2397 | 6365 |
| NM_003059 | SLC22A4 | solute carrier family 22 (organic cation transporter), member 4 | Transmembrane | 2398 | 6366 |
| NM_003064 | SLPI | secretory leukocyte protease inhibitor (antileukoproteinase) | Serine protease inhibitor, Repeat, Signal | 2399 | 6367 |
| NM_003066 | SLPI | secretory leukocyte protease inhibitor (antileukoproteinase) | Serine protease inhibitor, Repeat, Signal | 2400 | 6368 |
| NM_003071 | SMARCA3 | SWI/SNF related, matrix associated, actin dependent regulator of chromatin, subfamily a, member 3 | ATP-binding, DNA-binding, Helicase, Hydrolase, Metal-binding, Zinc, Zinc-finger | 2401 | 6369 |
| NM_003073 | SMARCB1 | SWI/SNF related, matrix associated, actin dependent regulator of chromatin, subfamily b, member 1 | Hypothetical protein, Transcription regulation, Activator, Nuclear protein, Alternative splicing, Anti-oncogene | 2402 | 6370 |
| NM_003074 | SMARCC1 | SWI/SNF related, matrix associated, actin dependent regulator of chromatin, subfamily c, member 1 | DNA-binding, Nuclear protein | 2403 | 6371 |
| NM_003077 | SMARCD2 | SWI/SNF related, matrix associated, actin dependent regulator of chromatin, subfamily d, member 2 | | 2404 | 6372 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003079 | SMARCE1 | SWI/SNE related, matrix associated, actin dependent regulator of chromatin, subfamily e, member 1 | | 2405 | 6373 |
| NM_003084 | SNAPC3 | small nuclear RNA activating complex, polypeptide 3, 50 kDa | Hypothetical protein, Transcription regulation, DNA-binding | 2406 | 6374 |
| NM_003085 | SNCB | synuclein, beta | Phosphorylation, Repeat | 2407 | 6375 |
| NM_003086 | SNAPC4 | small nuclear RNA activating complex, polypeptide 4, 190 kDa | DNA-binding, Nuclear protein, Hypothetical protein | 2408 | 6376 |
| NM_003088 | FSCN1 | fascin homolog 1, actin-bundling protein (*Strongylocentrotus purpuratus*) | Actin-binding, Acetylation, Phosphorylation, 3D-structure, Hypothetical protein | 2409 | 6377 |
| NM_003090 | SNRPA1 | small nuclear ribonucleoprotein polypeptide A' | Nuclear protein, RNA-binding, Ribonucleoprotein, Leucine-rich repeat, Repeat, 3D-structure | 2410 | 6378 |
| NM_003092 | SNRPB2 | small nuclear ribonucleoprotein polypeptide B" | mRNA processing, mRNA splicing, Nuclear protein, RNA-binding, Ribonucleoprotein, Repeat, Systemic lupus erythematosus, 3D-structure | 2411 | 6379 |
| NM_003093 | SNRPC | small nuclear ribonucleoprotein polypeptide C | Nuclear protein, RNA-binding, Ribonucleoprotein, Zinc-finger | 2412 | 6380 |
| NM_003094 | SNRPE | small nuclear ribonucleoprotein polypeptide E | Nuclear protein, Ribonucleoprotein, Systemic lupus erythematosus, mRNA splicing, mRNA processing, RNA-binding | 2413 | 6381 |
| NM_003100 | SNX2 | sorting nexin 2 | Transport, Protein transport | 2414 | 6382 |
| NM_003104 | SORD | sorbitol dehydrogenase | Oxidoreductase, Zinc, Metal-binding, NAD, Acetylation, Polymorphism | 2415 | 6383 |
| NM_003105 | SORL1 | sortilin-related receptor, L(DLR class) A repeats-containing | Endocytosis, Receptor, Transmembrane, EGF-like domain, Repeat, Glycoprotein, LDL, Lipid transport, Cholesterol metabolism, Signal | 2416 | 6384 |
| NM_003107 | SOX4 | SRY (sex determining region Y)-box 4 | DNA-binding, Nuclear protein, Transcription regulation, Activator | 2417 | 6385 |
| NM_003120 | SPI1 | spleen focus forming virus (SFFV) proviral integration oncogene spi1 | Proto-oncogene, DNA-binding, Transcription regulation, Activator, Nuclear protein | 2418 | 6386 |
| NM_003135 | SRP19 | signal recognition particle 19 kDa | Signal recognition particle, RNA-binding, Ribonucleoprotein, 3D-structure | 2419 | 6387 |
| NM_003141 | SSA1 | Sjogren syndrome antigen A1 (52 kDa, ribonucleoprotein autoantigen SS-A/Ro) | Systemic lupus erythematosus, Zinc-finger, Antigen, RNA-binding, Ribonucleoprotein, DNA-binding, Polymorphism | 2420 | 6388 |
| NM_003143 | SSBP1 | single-stranded DNA binding protein 1 | DNA-binding, DNA replication, Mitochondrion, Transit peptide, 3D-structure | 2421 | 6389 |
| NM_003146 | SSRP1 | structure specific recognition protein 1 | DNA-binding, Nuclear protein | 2422 | 6390 |
| NM_003150 | STAT3 | signal transducer and activator of transcription 3 (acute-phase response factor) | Hypothetical protein, Transcription regulation, Activator, DNA-binding, Nuclear protein, Phosphorylation, SH2 domain | 2423 | 6391 |
| NM_003153 | STAT6 | signal transducer and activator of transcription 6, interleukin-4 induced | Transcription regulation, Repressor, Alternative splicing, Activator, DNA-binding, Nuclear protein, Phosphorylation, SH2 domain, Polymorphism | 2424 | 6392 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003163 | STX1B1 | Human mRNA for SYNTAXIN1B, complete cds. | Neurotransmitter transport, Coiled coil, Transmembrane | 2425 | 6393 |
| NM_003168 | SUPT4H1 | suppressor of Ty 4 homolog 1 (S. cerevisiae) | Nuclear protein, Transcription, Zinc-finger | 2426 | 6394 |
| NM_003169 | SUPT5H | suppressor of Ty 5 homolog (S. cerevisiae) | | 2427 | 6395 |
| NM_003171 | SUPV3L1 | suppressor of var1, 3-like 1 (S. cerevisiae) | ATP-binding, Helicase, Hydrolase | 2428 | 6396 |
| NM_003174 | SVIL | supervillin | | 2429 | 6397 |
| NM_003177 | SYK | spleen tyrosine kinase | Transferase, Tyrosine-protein kinase, ATP-binding, Phosphorylation, SH2 domain, Repeat, Alternative splicing, 3D-structure | 2430 | 6398 |
| NM_003190 | TAPBP | TAP binding protein (tapasin) | Immunoglobulin domain, Signal, Transmembrane, Endoplasmic reticulum, Microsome, Alternative splicing, Polymorphism | 2431 | 6399 |
| NM_003191 | TARS | hypothetical protein MGC9344 | Aminoacyl-tRNA synthetase, Protein biosynthesis, Ligase, ATP-binding | 2432 | 6400 |
| NM_003193 | TBCE | tubulin-specific chaperone e | | 2433 | 6401 |
| NM_003197 | TCEB1L | S-phase kinase-associated protein 1A (p19A) | Ubl conjugation pathway, Alternative splicing, 3D-structure | 2434 | 6402 |
| NM_003199 | TCF4 | transcription factor 4 | Transcription regulation, DNA-binding, Activator, Nuclear protein, Alternative splicing | 2435 | 6403 |
| NM_003201 | TFAM | transcription factor A, mitochondrial | Transcription regulation, DNA-binding, Activator, Mitochondrion, Transit peptide, Repeat, Polymorphism | 2436 | 6404 |
| NM_003202 | TCF7 | transcription factor 7 (T-cell specific, HMG-box) | Transcription regulation, Activator, Repressor, Trans-acting factor, Nuclear protein, DNA-binding, Wnt signaling pathway, Alternative splicing, Alternative promoter usage | 2437 | 6405 |
| NM_003203 | C2orf3 | chromosome 2 open reading frame 3 | | 2438 | 6406 |
| NM_003205 | TCF12 | transcription factor 12 (HTF4, helix-loop-helix transcription factors 4) | Transcription regulation, DNA-binding, Nuclear protein, Developmental protein | 2439 | 6407 |
| NM_003217 | TEGT | testis enhanced gene transcript (BAX inhibitor 1) | Apoptosis, Transmembrane | 2440 | 6408 |
| NM_003226 | TFF3 | trefoil factor 3 (intestinal) | Signal, 3D-structure | 2441 | 6409 |
| NM_003227 | TFR2 | transferrin receptor 2 | Transmembrane, Glycoprotein, Receptor, Signal-anchor, Alternative splicing, Disease mutation | 2442 | 6410 |
| NM_003236 | TGFA | transforming growth factor, alpha | EGF-like domain, Growth factor, Mitogen, Glycoprotein, Transmembrane, Signal, 3D-structure, Lipoprotein, Palmitate | 2443 | 6411 |
| NM_003245 | TGM3 | transglutaminase 3 (E polypeptide, protein-glutamine-gamma-glutamyltransferase) | Transferase, Acyltransferase, Calcium-binding, Zymogen, Keratinization, 3D-structure | 2444 | 6412 |
| NM_003248 | THBS4 | thrombospondin 4 | Glycoprotein, Cell adhesion, Calcium-binding, Repeat, EGF like domain, Signal | 2445 | 6413 |
| NM_003252 | TIAL1 | TIA1 cytotoxic granule-associated RNA binding protein-like 1 | RNA-binding, Apoptosis, Repeat | 2446 | 6414 |
| NM_003255 | TIMP2 | tissue inhibitor of metalloproteinase 2 | Hypothetical protein, Metalloprotease inhibitor, Signal, 3D-structure | 2447 | 6415 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003263 | TLR1 | toll-like receptor 1 | Receptor, Immune response, Inflammatory response, Signal, Transmembrane, Repeat, Leucine-rich repeat, Glycoprotein, 3D-structure | 2448 | 6416 |
| NM_003274 | TMEM1 | transmembrane protein 1 | Transport, Endoplasmic reticulum, Golgi stack, Polymorphism | 2449 | 6417 |
| NM_003281 | TNNI1 | troponin I, skeletal, slow | Muscle protein, Actin-binding, Ubl conjugation pathway, Hydrolase, Thiol protease, Multigene family | 2450 | 6418 |
| NM_003288 | TPD52L2 | tumor protein D52-like 2 | Coiled coil, Alternative splicing | 2451 | 6419 |
| NM_003289 | TPM2 | tropomyosin 2 (beta) | Muscle protein, Cytoskeleton, Actin-binding, Coiled coil, Alternative splicing, Multigene family, Acetylation, Disease mutation | 2452 | 6420 |
| NM_003290 | TPM4 | tropomyosin 4 | Muscle protein, Cytoskeleton, Actin-binding, Coiled coil, Alternative splicing, Multigene family | 2453 | 6421 |
| NM_003299 | TRA1 | tumor rejection antigen (gp96) 1 | Chaperone, Endoplasmic reticulum, Glycoprotein, Calcium-binding, Signal | 2454 | 6422 |
| NM_003307 | TRPM2 | Homo sapiens transient receptor potential cation channel, subfamily M, member 2 (TRPM2), mRNA. | Ionic channel, Transmembrane, Ion transport, Calcium channel, Alternative splicing | 2455 | 6423 |
| NM_003310 | TSSC1 | tumor suppressing subtransferable candidate 1 | Repeat, WD repeat | 2456 | 6424 |
| NM_003316 | TTC3 | tetratricopeptide repeat domain 3 | Metal-binding, Zinc, Zinc-finger, Repeat, TPR repeat, Alternative splicing, Polymorphism | 2457 | 6425 |
| NM_003326 | TNFSF4 | tumor necrosis factor (ligand) superfamily, member 4 (tax-transcriptionally activated glycoprotein 1, 34 kDa) | Cytokine, Transmembrane, Glycoprotein, Signal-anchor | 2458 | 6426 |
| NM_003329 | TXN | thioredoxin | Redox-active center, Electron transport, 3D-structure | 2459 | 6427 |
| NM_003330 | TXNRD1 | thioredoxin reductase 1 | Redox-active center, Oxidoreductase, NADP, Flavoprotein, FAD | 2460 | 6428 |
| NM_003331 | TYK2 | tyrosine kinase 2 | Transferase, Tyrosine-protein kinase, ATP-binding, Phosphorylation, SH2 domain, Repeat | 2461 | 6429 |
| NM_003332 | TYROBP | TYRO protein tyrosine kinase binding protein | Transmembrane, Signal, Phosphorylation, Polymorphism, Receptor | 2462 | 6430 |
| NM_003338 | UBE2D1 | ubiquitin-conjugating enzyme E2D 1 (UBC4/5 homolog, yeast) | Ubl conjugation pathway, Ligase, Multigene family | 2463 | 6431 |
| NM_003341 | UBE2E1 | ubiquitin-conjugating enzyme E2E 1 (UBC4/5 homolog, yeast) | Ubl conjugation pathway, Ligase, Multigene family | 2464 | 6432 |
| NM_003343 | UBE2G2 | ubiquitin-conjugating enzyme E2G 2 (UBC7 homolog, yeast) | Ubl conjugation pathway, Ligase, Multigene family, Hypothetical protein | 2465 | 6433 |
| NM_003348 | UBE2N | ubiquitin-conjugating enzyme E2N (UBC13 homolog, yeast) | Ubl conjugation pathway, Ligase, Multigene family, 3D-structure | 2466 | 6434 |
| NM_003358 | UCP2 | uncoupling protein 2 (mitochondrial, proton carrier) | Mitochondrion, Inner membrane, Repeat, Transmembrane, Transport, Polymorphism | 2467 | 6435 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003355 | UGCG | UDP-glucose ceramide glucosyltransferase | Transferase, Glycosyltransferase, Transmembrane, Signal-anchor, Endoplasmic reticulum | 2468 | 6436 |
| NM_003362 | UNG | uracil-DNA glycosylase | DNA repair, Hydrolase, Glycosidase, Nuclear protein, Mitochondrion, Transit peptide, Disease mutation, Alternative splicing, 3D-structure | 2469 | 6437 |
| NM_003364 | UP | uridine phosphorylase 1 | Transferase, Glycosyltransferase, Alternative splicing | 2470 | 6438 |
| NM_003366 | UQCRC2 | ubiquinol-cytochrome c reductase core protein II | Mitochondrion, Inner membrane, Electron transport, Respiratory chain, Oxidoreductase, Transit peptide | 2471 | 6439 |
| NM_003370 | VASP | vasodilator-stimulated phosphoprotein | Phosphorylation, Actin-binding, 3D-structure | 2472 | 6440 |
| NM_003374 | VDAC1 | voltage-dependent anion channel 1 | Outer membrane, Porin, Mitochondrion, Acetylation | 2473 | 6441 |
| NM_003375 | VDAC2 | voltage-dependent anion channel 2 | Outer membrane, Porin, Mitochondrion, Alternative splicing, Polymorphism | 2474 | 6442 |
| NM_003377 | VEGFB | vascular endothelial growth factor B | Mitogen, Growth factor, Glycoprotein, Signal, Heparin-binding, Alternative splicing, Multigene family | 2475 | 6443 |
| NM_003387 | WASPIP | Wiskott-Aldrich syndrome protein interacting protein | Actin-binding, Repeat, Polymorphism | 2476 | 6444 |
| NM_003389 | CORO2A | coronin, actin binding protein, 2A | Actin-binding, Repeat, WD repeat, Coiled coil | 2477 | 6445 |
| NM_003403 | YY1 | YY1 transcription factor | Transcription regulation, Repressor, Activator, Nuclear protein, Zinc-finger, Metal-binding, DNA-binding, Repeat, 3D-structure | 2478 | 6446 |
| NM_003407 | ZFP36 | zinc finger protein 36, C3H type, homolog (mouse) | Nuclear protein, Repeat, Metal-binding, Zinc-finger, DNA-binding | 2479 | 6447 |
| NM_003426 | ZNF74 | zinc finger protein 74 (Cos52) | Transcription regulation, DNA-binding, RNA-binding, Zinc-finger, Metal-binding, Nuclear protein, Repeat, Alternative splicing, Polymorphism | 2480 | 6448 |
| NM_003451 | ZNF177 | zinc finger protein 177 | Transcription regulation, DNA-binding, Zinc-finger, Metal-binding, Nuclear protein, Repeat, Hypothetical protein | 2481 | 6449 |
| NM_003457 | ZNF207 | zinc finger protein 207 | Zinc-finger, Metal-binding, DNA-binding, Nuclear protein, Alternative splicing, Hypothetical protein | 2482 | 6450 |
| NM_003461 | ZYX | zyxin | LIM domain, Metal-binding, Zinc, Repeat, Cell adhesion, Receptor | 2483 | 6451 |
| NM_003465 | CHIT1 | chitinase 1 (chitotriosidase) | Carbohydrate metabolism, Chitin degradation, Polysaccharide degradation, Hydrolase, Glycosidase, Chitin-binding, Signal, Alternative splicing, 3D-structure | 2484 | 6452 |
| NM_003466 | PAX8 | paired box gene 8 | DNA-binding, Developmental protein, Nuclear protein, Paired box, Transcription, Transcription regulation, Differentiation, Alternative splicing, Disease mutation, Polymorphism | 2485 | 6453 |
| NM_003467 | CXCR4 | chemokine (C—X—C motif) receptor 4 | G-protein coupled receptor, Receptor, Transmembrane, Glycoprotein, Sulfation, Antigen, Alternative splicing | 2486 | 6454 |
| NM_003475 | C11orf13 | chromosome 11 open reading frame 13 | Coiled coil, Alternative splicing | 2487 | 6455 |
| NM_003477 | PDX1 | pyruvate dehydrogenase complex, component X | Transit peptide, Mitochondrion, Lipoyl, Hypothetical protein, Acyltransferase, Transferase | 2488 | 6456 |
| NM_003489 | NRIP1 | nuclear receptor interacting protein 1 | Transcription regulation, Nuclear protein | 2489 | 6457 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003493 | HIST3H3 | histone 3, H3 | Nuclear protein, Chromosomal protein, DNA-binding, Nucleosome core, Multigene family, Acetylation, Methylation | 2490 | 6458 |
| NM_003494 | DYSF | dysferlin, limb girdle muscular dystrophy 2B (autosomal recessive) | Transmembrane, Repeat, Disease mutation, Hypothetical protein | 2491 | 6459 |
| NM_003498 | SNN | stannin | Transmembrane, Hypothetical protein | 2492 | 6460 |
| NM_003507 | FZD7 | frizzled homolog 7 (*Drosophila*) | Multigene family, G-protein coupled receptor, Transmembrane, Developmental protein, Wnt signaling pathway, Glycoprotein, Signal | 2493 | 6461 |
| NM_003508 | FZD9 | frizzled homolog 9 (*Drosophila*) | Multigene family, G-protein coupled receptor, Transmembrane, Developmental protein, Wnt signaling pathway, Glycoprotein, Signal | 2494 | 6462 |
| NM_003530 | HIST1H3D | histone 1, H3d | Nuclear protein, Chromosomal protein, DNA-binding, Nucleosome core, Multigene family, Acetylation, Methylation | 2495 | 6463 |
| NM_003532 | HIST1H3E | histone 1, H3c | Nuclear protein, Chromosomal protein, DNA-binding, Nucleosome core, Multigene family, Acetylation, Methylation | 2496 | 6464 |
| NM_003534 | HIST1H3G | histone 1, H3g | Nuclear protein, Chromosomal protein, DNA-binding, Nucleosome core, Multigene family, Acetylation, Methylation | 2497 | 6465 |
| NM_003535 | HIST1H3J | histone 1, H3j | Nuclear protein, Chromosomal protein, DNA-binding, Nucleosome core, Multigene family, Acetylation, Methylation | 2498 | 6466 |
| NM_003549 | HYAL3 | hyaluronoglucosaminidase 3 | EGE-like domain | 2499 | 6467 |
| NM_003560 | PLA2G6 | phospholipase A2, group VI (cytosolic, calcium-independent) | Hypothetical protein, ANK repeat, Repeat, Hydrolase, Lipid degradation, Membrane, Alternative splicing | 2500 | 6468 |
| NM_003562 | SLC25A11 | solute carrier family 25 (mitochondrial carrier; oxoglutarate carrier), member 11 | Mitochondrion, Inner membrane, Repeat, Transmembrane, Transport | 2501 | 6469 |
| NM_003565 | ULK1 | unc-51-like kinase 1 (*C. elegans*) | Hypothetical protein, ATP-binding, Transferase, Serine/threonine-protein kinase | 2502 | 6470 |
| NM_003570 | CMAH | MRNA for CMP-N-acetylneuraminic acid hydroxylase, complete cds. | | 2503 | 6471 |
| NM_003577 | UTF1 | undifferentiated embryonic cell transcription factor 1 | | 2504 | 6472 |
| NM_003579 | RAD54L | RAD54-like (*S. cerevisiae*) | ATP-binding, DNA repair, Helicase, Hydrolase | 2505 | 6473 |
| NM_003587 | DDX16 | DEAH (Asp-Glu-Ala-His) box polypeptide 16 | ATP-binding, Helicase, Hydrolase, mRNA processing, mRNA splicing, Nuclear protein | 2506 | 6474 |
| NM_00359 | SUPT3H | suppressor of Ty 3 homolog (*S. cerevisiae*) | Transcription regulation, Activator, Nuclear protein, Alternative splicing | 2507 | 6475 |
| NM_003601 | SMARCA5 | SWI/SNF related, matrix associated, actin dependent regulator of chromatin, subfamily a, member 5 | ATP-binding, DNA-binding, Helicase, Hydrolase, Nuclear protein | 2508 | 6476 |
| NM_003618 | MAP4K3 | mitogen-activated protein kinase kinase kinase kinase 3 | ATP-binding, Kinase, Transferase | 2509 | 6477 |
| NM_003624 | RANBP3 | RAN binding protein 3 | Hypothetical protein | 2510 | 6478 |
| NM_003634 | NIPSNAP1 | nipsnap homolog 1 (*C. elegans*) | Polymorphism | 2511 | 6479 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003635 | NDST2 | N-deacetylase/N-sulfotransferase (heparan glucosaminyl) 2 | Hypothetical protein, Transferase, Transmembrane, Glycoprotein, Golgi stack, Signal-anchor | 2512 | 6480 |
| NM_003636 | KCNAB2 | potassium voltage-gated channel, shaker-related subfamily, beta member 2 | Ionic channel, Ion transport, Potassium transport, Voltage-gated channel, Alternative splicing | 2513 | 6481 |
| NM_003639 | IKBKG | inhibitor of kappa light polypeptide gene enhancer in B-cells, kinase gamma | Coiled coil, Transcription regulation, Nuclear protein, Disease mutation, Anhidrotic ectodermal dysplasia, Repeat, LIM domain, Metal-binding, Zinc, Developmental protein, Differentiation, Zinc-finger | 2514 | 6482 |
| NM_003644 | GAS7 | growth arrest-specific 7 | Neurogenesis, Developmental protein, Coiled coil, Proto-oncogene, Chromosomal translocation, Alternative splicing | 2515 | 6483 |
| NM_003648 | DGKD | diacylglycerol kinase, delta 130 kDa | Transferase, Kinase, Phorbol-ester binding, Repeat, Multigene family | 2516 | 6484 |
| NM_003650 | CST7 | cystatin F (leukocystatin) | Thiol protease inhibitor, Glycoprotein, Signal | 2517 | 6485 |
| NM_003655 | CBX4 | chromobox homolog 4 (Pc class homolog, *Drosophila*) | Chromatin regulator, Nuclear protein, Transcription regulation, Repressor, Alternative splicing | 2518 | 6486 |
| NM_003668 | MAPKAPK5 | mitogen-activated protein kinase-activated protein kinase 5 | Hypothetical protein, ATP-binding, Kinase, Serine/threonine-protein kinase, Transferase | 2519 | 6487 |
| NM_003674 | CDK10 | cyclin-dependent kinase (CDC2-like) 10 | Transferase, Serine/threonine-protein kinase, ATP-binding, Kinase, Cyclin | 2520 | 6488 |
| NM_003680 | YARS | tyrosyl-tRNA synthetase | Aminoacyl-tRNA synthetase, Protein biosynthesis, Ligase, ATP-binding, RNA-binding, tRNA-binding, 3D-structure | 2521 | 6489 |
| NM_003681 | PDXK | pyridoxal (pyridoxine, vitamin B6) kinase | Transferase, Kinase, Alternative splicing | 2522 | 6490 |
| NM_003682 | MADD | MAP-kinase activating death domain | Hypothetical protein, Kinase | 2523 | 6491 |
| NM_003685 | KHSRP | KH-type splicing regulatory protein (FUSE binding protein 2) | Transport, mRNA transport, mRNA processing, mRNA splicing, Transcription regulation, Trans-acting factor, Nuclear protein, DNA-binding, RNA-binding, Repeat | 2524 | 6492 |
| NM_003686 | EXO1 | exonuclease 1 | Exonuclease, Hypothetical protein | 2525 | 6493 |
| NM_003690 | PRKRA | protein kinase, interferon-inducible double stranded RNA dependent activator | Hypothetical protein, Kinase | 2526 | 6494 |
| NM_003707 | RUVBL1 | RuvB-like 1 (*E. coli*) | Transcription, DNA recombination, ATP-binding, Hydrolase, Helicase, Nuclear protein | 2527 | 6495 |
| NM_003709 | KLF7 | Kruppel-like factor 7 (ubiquitous) | Transcription regulation, Activator, Zinc-finger, Metal-binding, DNA-binding, Nuclear protein, Repeat | 2528 | 6496 |
| NM_003713 | PPAP2B | phosphatidic acid phosphatase type 2B | Collagen, Hydrolase, Hypothetical protein | 2529 | 6497 |
| NM_003725 | RODH | 3-hydroxysteroid epimerase | Oxidoreductase | 2530 | 6498 |
| NM_003726 | SCAP1 | src family associated phosphoprotein 1 | SH3 domain | 2531 | 6499 |
| NM_003730 | RNASE6PL | ribonuclease T2 | Hydrolase, Nuclease, Endonuclease, Glycoprotein, Signal, Alternative splicing, Polymorphism, Hypothetical protein | 2532 | 6500 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003734 | AOC3 | amine oxidase, copper containing 3 (vascular adhesion protein 1) | Oxidoreductase, Copper, TPQ, Glycoprotein, Transmembrane, Signal-anchor, Cell adhesion, Polymorphism, Metal-binding | 2533 | 6501 |
| NM_003748 | ALDH4A1 | aldehyde dehydrogenase 4 family, member A1 | Oxidoreductase, NAD, Proline metabolism, Mitochondrion, Transit peptide, Polymorphism, Disease mutation | 2534 | 6502 |
| NM_003750 | EIF3S10 | eukaryotic translation initiation factor 3, subunit 10 theta, 150/170 kDa | Initiation factor, Protein biosynthesis, Repeat, Phosphorylation | 2535 | 6503 |
| NM_003754 | EIF3S5 | eukaryotic translation initiation factor 3, subunit 5 epsilon, 47 kDa | Initiation factor, Protein biosynthesis, Polymorphism, Hypothetical protein | 2536 | 6504 |
| NM_003755 | EIF3S4 | eukaryotic translation initiation factor 3, subunit 4 delta, 44 kDa | Initiation factor, Protein biosynthesis, RNA-binding | 2537 | 6505 |
| NM_003756 | EIF3S3 | eukaryotic translation initiation factor 3, subunit 3 gamma, 40 kDa | Initiation factor, Protein biosynthesis | 2538 | 6506 |
| NM_003758 | EIF3S1 | eukaryotic translation initiation factor 3, subunit 1 alpha, 35 kDa | Hypothetical protein, Initiation factor, Protein biosynthesis | 2539 | 6507 |
| NM_003764 | STX11 | syntaxin 11 | Coiled coil, Membrane, Polymorphism | 2540 | 6508 |
| NM_003765 | STX10 | syntaxin 10 | Coiled coil, Transmembrane, Transport, Protein transport, Golgi stack, Alternative splicing | 2541 | 6509 |
| NM_003769 | SFRS9 | splicing factor, arginine/serine-rich 9 | Nuclear protein, RNA-binding, mRNA splicing, Repeat, Phosphorylation | 2542 | 6510 |
| NM_003776 | MRPL40 | mitochondrial ribosomal protein L40 | Ribosomal protein, Mitochondrion, Transit peptide, Polymorphism | 2543 | 6511 |
| NM_003782 | B3GALT4 | UDP-Gal: betaGlcNAc beta 1,3-galactosyltransferase, polypeptide 4 | Transferase, Glycosyltransferase, Glycoprotein, Transmembrane, Signal-anchor, Golgi stack | 2544 | 6512 |
| NM_003786 | ABCC3 | ATP-binding cassette, sub-family C (CFTR/MRP), member 3 | ATP-binding, Glycoprotein, Transmembrane, Transport, Repeat, Alternative splicing | 2545 | 6513 |
| NM_003791 | MBTPS1 | membrane-bound transcription factor protease, site 1 | Hydrolase, Protease, Serine protease, Lipid metabolism, Cholesterol metabolism, Signal, Transmembrane, Endoplasmic reticulum, Golgi stack, Zymogen, Autocatalytic cleavage, Glycoprotein, Calcium | 2546 | 6514 |
| NM_003796 | C19orf2 | chromosome 19 open reading frame 2 | Nuclear protein | 2547 | 6515 |
| NM_003801 | GPAA1 | GPAA1P anchor attachment protein 1 homolog (yeast) | Hypothetical protein | 2548 | 6516 |
| NM_003805 | CRADD | CASP2 and RIPK1 domain containing adaptor with death domain | Apoptosis, 3D-structure | 2549 | 6517 |
| NM_003807 | TNFSF14 | tumor necrosis factor (ligand) superfamily, member 14 | Cytokine, Transmembrane, Glycoprotein, Signal-anchor, Alternative splicing | 2550 | 6518 |
| NM_003808 | TNFSF13 | tumor necrosis factor (ligand) superfamily, member 13 | Cytokine, Immune response, Glycoprotein, Alternative splicing | 2551 | 6519 |
| NM_003815 | ADAM15 | a disintegrin and metalloproteinase domain 15 (metargidin) | Hydrolase, Metalloprotease, Zinc, Signal, Glycoprotein, Zymogen, Transmembrane, EGF-like domain, SH3-binding, Phosphorylation | 2552 | 6520 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003820 | TNFRSF14 | tumor necrosis factor receptor superfamily, member 14 (herpesvirus entry mediator) | Receptor, Transmembrane, Glycoprotein, Repeat, Signal, Polymorphism, 3D-structure | 2553 | 6521 |
| NM_003829 | MPDZ | multiple PDZ domain protein | Hypothetical protein | 2554 | 6522 |
| NM_003830 | SIGLEC5 | sialic acid binding Ig-like lectin 5 | Cell adhesion, Lectin, Transmembrane, Signal, Glycoprotein, Immunoglobulin domain, Repeat, Antigen, Polymorphism | 2555 | 6523 |
| NM_003841 | TNFRSF10C | tumor necrosis factor receptor superfamily, member 10c, decoy without an intracellular domain | Receptor, Apoptosis, Glycoprotein, Repeat, GPI-anchor, Signal, Lipoprotein | 2556 | 6524 |
| NM_003846 | PEX11B | peroxisomal biogenesis factor 11B | | 2557 | 6525 |
| NM_003852 | TIF1 | transcriptional intermediary factor 1 | Elongation factor, Protein biosynthesis, GTP-binding, Methylation, Multigene family, Transcription regulation, Repressor, DNA-binding, Bromodomain, Zinc-finger, Alternative splicing, Nuclear protein, Coiled coil, Repeat | 2558 | 6526 |
| NM_003853 | IL18RAP | interleukin 18 receptor accessory protein | Receptor | 2559 | 6527 |
| NM_003866 | INPP4B | inositol polyphosphate-4-phosphatase, type II, 105 kDa | Hypothetical protein | 2560 | 6528 |
| NM_003877 | SOCS2 | suppressor of cytokine signaling 2 | SH2 domain, Growth regulation, Signal transduction inhibitor | 2561 | 6529 |
| NM_003887 | DDEF2 | development and differentiation enhancing factor 2 | Hypothetical protein, ANK repeat, Repeat, SH3 domain | 2562 | 6530 |
| NM_003893 | LDB1 | LIM domain binding 1 | DNA-binding, Homeobox, Nuclear protein | 2563 | 6531 |
| NM_003895 | SYNJ1 | synaptojanin 1 | Hydrolase, Alternative splicing, Repeat, Endocytosis, RNA-binding, Multigene family, Hypothetical protein | 2564 | 6532 |
| NM_003896 | SIAT9 | sialyltransferase 9 (CMP-NeuAc: lactosylceramide alpha-2,3-sialyltransferase; GM3 synthase) | Transferase, Glycosyltransferase, Glycoprotein, Transmembrane, Signal-anchor, Golgi stack | 2565 | 6533 |
| NM_003897 | IER3 | immediate early response 3 | Glycoprotein, Transmembrane, Signal-anchor | 2566 | 6534 |
| NM_003899 | ARHGEF7 | Rho guanine nucleotide exchange factor (GEF) 7 | Hypothetical protein, SH3 domain, Guanine-nucleotide releasing factor, Alternative splicing, 3D-structure | 2567 | 6535 |
| NM_003900 | SQSTM1 | sequestosome 1 | Hypothetical protein | 2568 | 6536 |
| NM_003903 | CDC16 | CDC16 cell division cycle 16 homolog (S. cerevisiae) | Ubl conjugation pathway, Cell cycle, Cell division, Mitosis, Repeat, TPR repeat, Alternative splicing | 2569 | 6537 |
| NM_003904 | ZNF259 | zinc finger protein 259 | Nuclear protein, Zinc-finger | 2570 | 6538 |
| NM_003905 | APPBP1 | amyloid beta precursor protein binding protein 1, 59 kDa | Hypothetical protein | 2571 | 6539 |
| NM_003909 | CPNE3 | copine III | Repeat, Phosphorylation, Transferase, Serine/threonine-protein kinase | 2572 | 6540 |
| NM_003915 | CPNE1 | copine I | Repeat | 2573 | 6541 |
| NM_003923 | FOXH1 | forkhead box H1 | Transcription regulation, Activator, DNA-binding, Nuclear protein, Polymorphism | 2574 | 6542 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_003931 | WASF1 | WAS protein family, member 1 | Actin-binding | 2575 | 6543 |
| NM_003938 | AP3D1 | adaptor-related protein complex 3, delta 1 subunit | Golgi stack, Protein transport, Transport, Alternative splicing, Polymorphism | 2576 | 6544 |
| NM_003940 | USP13 | ubiquitin specific protease 13 (isopeptidase T-3) | Ubl conjugation pathway, Hydrolase, Thiol protease, Multigene family, Repeat, Hypothetical protein | 2577 | 6545 |
| NM_003943 | GENX-3414 | genethonin 1 | | 2578 | 6546 |
| NM_003945 | ATP6V0E | ATPase, H+ transporting, lysosomal 9 kDa, V0 subunit e | Hydrolase, Hydrogen ion transport, Transmembrane | 2579 | 6547 |
| NM_003951 | SLC25A14 | solute carrier family 25 (mitochondrial carrier, brain), member 14 | Mitochondrion, Repeat, Transmembrane, Transport, Alternative splicing | 2580 | 6548 |
| NM_003953 | MPZL1 | myelin protein zero-like 1 | Hypothetical protein | 2581 | 6549 |
| NM_003954 | MAP3K14 | mitogen-activated protein kinase kinase kinase 14 | Hypothetical protein, Transferase, Serine/threonine-protein kinase, ATP-binding, Phosphorylation | 2582 | 6550 |
| NM_003967 | PNR | putative neurotransmitter receptor | G-protein coupled receptor, Receptor, Transmembrane | 2583 | 6551 |
| NM_003975 | SH2D2A | SH2 domain protein 2A | Angiogenesis, Phosphorylation, SH2 domain, SH3-binding, Alternative splicing | 2584 | 6552 |
| NM_003977 | AIP | aryl hydrocarbon receptor interacting protein | Repeat, TPR repeat | 2585 | 6553 |
| NM_003978 | PSTPIP1 | proline-serine-threonine phosphatase interacting protein 1 | SH3 domain | 2586 | 6554 |
| NM_003983 | SLC7A6 | solute carrier family 7 (cationic amino acid transporter, y+ system), member 6 | Hypothetical protein | 2587 | 6555 |
| NM_004031 | IRF7 | interferon regulatory factor 7 | Transcription regulation, DNA-binding, Nuclear protein, Activator, Alternative splicing, Collagen | 2588 | 6556 |
| NM_004033 | ANXA6 | annexin A6 | Annexin, Calcium/phospholipid-binding, Repeat, Acetylation, Phosphorylation, 3D-structure | 2589 | 6557 |
| NM_004037 | AMPD2 | adenosine monophosphate deaminase 2 (isoform L) | Hydrolase, Nucleotide metabolism, Multigene family, Alternative splicing | 2590 | 6558 |
| NM_004039 | ANXA2 | annexin A2 | Annexin, Calcium, Calcium-binding, Calcium/phospholipid-binding, Repeat, Phosphorylation, Acetylation, Polymorphism | 2591 | 6559 |
| NM_004044 | ATIC | 5-aminoimidazole-4-carboxamide ribonucleotide formyltransferase/IMP cyclohydrolase | Purine biosynthesis, Transferase, Hydrolase, Multifunctional enzyme | 2592 | 6560 |
| NM_004046 | ATP5A1 | ATP synthase, H+ transporting, mitochondrial F1 complex, alpha subunit, isoform 1, cardiac muscle | ATP synthesis, ATP-binding, CF(1), Hydrogen ion transport, Hydrolase, Ion transport, Transport, Mitochondrion, Transit peptide, Pyrrolidone carboxylic acid, Hypothetical protein | 2593 | 6561 |
| NM_004047 | ATP6V0B | ATPase, H+ transporting, lysosomal 21 kDa, V0 subunit c" | Hydrolase, Hydrogen ion transport, ATP synthesis, Transmembrane | 2594 | 6562 |
| NM_004049 | BCL2A1 | BCL2-related protein A1 | Apoptosis | 2595 | 6563 |
| NM_004053 | BYSL | bystin-like | Cell adhesion | 2596 | 6564 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004054 | C3AR1 | complement component 3a receptor 1 | G-protein coupled receptor, Transmembrane, Glycoprotein, Chemotaxis | 2597 | 6565 |
| NM_004060 | CCNG1 | cyclin G1 | Cyclin, Cell cycle, Cell division, Mitosis, Nuclear protein | 2598 | 6566 |
| NM_004070 | CLCNKA | chloride channel Ka | Ionic channel, Ion transport, Chloride channel, Chloride, Voltage-gated channel, Transmembrane, CBS domain, Repeat | 2599 | 6567 |
| NM_004073 | CNK | cytokine-inducible kinase | Transferase, Serine/threonine-protein kinase, ATP-binding, Repeat, Phosphorylation, Hypothetical protein, Kinase | 2600 | 6568 |
| NM_004079 | CTSS | cathepsin S | Hydrolase, Thiol protease, Lysosome, Zymogen, Signal, 3D-structure | 2601 | 6569 |
| NM_004084 | DEFA1 | defensin, alpha 1, myeloid-related sequence | Defensin, Antibiotic, Antiviral, Fungicide, Signal, 3D-structure | 2602 | 6570 |
| NM_004090 | DUSP3 | dual specificity phosphatase 3 (vaccinia virus phosphatase VH1-related) | Hydrolase, 3D-structure, Hypothetical protein | 2603 | 6571 |
| NM_004092 | ECHS1 | enoyl Coenzyme A hydratase, short chain, 1, mitochondrial | Fatty acid metabolism, Lyase, Mitochondrion, Transit peptide | 2604 | 6572 |
| NM_004094 | EIF2S1 | eukaryotic translation initiation factor 2, subunit 1 alpha, 35 kDa | Initiation factor, Protein biosynthesis, Translation regulation, RNA-binding, Phosphorylation, 3D-structure | 2605 | 6573 |
| NM_004099 | STOM | stomatin | Erythrocyte, Transmembrane, Phosphorylation, Lipoprotein, Palmitate, Hypothetical protein, Transducer, Prenylation, Multigene family | 2606 | 6574 |
| NM_004105 | EFEMP1 | EGF-containing fibulin-like extracellular matrix protein 1 | Repeat, EGF-like domain, Calcium-binding, Glycoprotein, Signal, Disease mutation, Polymorphism, Alternative splicing | 2607 | 6575 |
| NM_004106 | FCER1G | Fc fragment of IgE, high affinity I, receptor for; gamma polypeptide | IgE-binding protein, Receptor, Transmembrane, Signal | 2608 | 6576 |
| NM_004107 | FCGRT | Fc fragment of IgG, receptor, transporter, alpha | IgG-binding protein, Receptor, Transmembrane, Glycoprotein, Signal, Immunoglobulin domain, 3D-structure | 2609 | 6577 |
| NM_004108 | FCN2 | ficolin (collagen/fibrinogen domain containing lectin) 2 (hucolin) | Lectin, Collagen, Repeat, Glycoprotein, Signal, Multigene family | 2610 | 6578 |
| NM_004109 | FDX1 | ferredoxin 1 | Metal-binding, Iron-sulfur, Iron, 2Fe—2S, Electron transport, Mitochondrion, Transit peptide | 2611 | 6579 |
| NM_004115 | FGF14 | fibroblast growth factor 14 | Growth factor | 2612 | 6580 |
| NM_004119 | FLT3 | fms-related tyrosine kinase 3 | Signal, Transferase, Tyrosine-protein kinase, Receptor, Transmembrane, Glycoprotein, Phosphorylation, ATP-binding, Immunoglobulin domain | 2613 | 6581 |
| NM_004122 | GHSR | growth hormone secretagogue receptor | G-protein coupled receptor, Transmembrane, Glycoprotein, Alternative splicing | 2614 | 6582 |
| NM_004126 | GNG11 | guanine nucleotide binding protein (G protein), gamma 11 | Transducer, Prenylation, Lipoprotein, Multigene family | 2615 | 6583 |
| NM_004128 | GTF2F2 | general transcription factor IIF, polypeptide 2, 30 kDa | Transcription regulation, DNA-binding, Helicase, ATP-binding, Nuclear protein, 3D-structure | 2616 | 6584 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004130 | GYG | glycogenin | Transferase, Glycogen biosynthesis, Acetylation, Phosphorylation, Glycoprotein, Alternative splicing, Hypothetical protein | 2617 | 6585 |
| NM_004131 | GZMB | granzyme B (granzyme 2, cytotoxic T-lymphocyte-associated serine esterase 1) | Hydrolase, Serine protease, Zymogen, Signal, T-cell, Cytolysis, Apoptosis, Glycoprotein, 3D-structure, Protease | 2618 | 6586 |
| NM_004134 | HSPA9B | heat shock 70 kDa protein 9B (mortalin-2) | ATP-binding, Heat shock, Chaperone, Mitochondrion, Transit peptide | 2619 | 6587 |
| NM_004147 | DRG1 | developmentally regulated GTP binding protein 1 | GTP-binding, Hypothetical protein | 2620 | 6588 |
| NM_004148 | NINJ1 | ninjurin 1 | Cell adhesion, Transmembrane, Hypothetical protein | 2621 | 6589 |
| NM_004152 | OAZ1 | ornithine decarboxylase antizyme 1 | | 2622 | 6590 |
| NM_004168 | SDHA | succinate dehydrogenase complex, subunit A, flavoprotein (Fp) | Tricarboxylic acid cycle, Flavoprotein, FAD, Oxidoreductase, Electron transport, Mitochondrion, Transit peptide, Disease mutation, Leigh syndrome | 2623 | 6591 |
| NM_004177 | STX3A | syntaxin 3A | Neurotransmitter transport, Coiled coil, Transmembrane, Alternative splicing | 2624 | 6592 |
| NM_004178 | TARBP2 | TAR (HIV) RNA binding protein 2 | Hypothetical protein, RNA-binding, Repeat, Nuclear protein | 2625 | 6593 |
| NM_004180 | TANK | TRAF family member-associated NFKB activator | Zinc-finger, Metal-binding, Alternative splicing, 3D-structure | 2626 | 6594 |
| NM_004183 | VMD2 | vitelliform macular dystrophy (Best disease, bestrophin) | Transport, Ion transport, Ionic channel, Chloride channel, Chloride, Calcium, Alternative splicing, Disease mutation, Polymorphism, Vision, Transmembrane, Phosphorylation, Iron storage, Metal-binding, 3D-structure | 2627 | 6595 |
| NM_004207 | SLC16A3 | solute carrier family 16 (monocarboxylic acid transporters), member 3 | Transport, Symport, Transmembrane, Multigene family | 2628 | 6596 |
| NM_004221 | NK4 | natural killer cell transcript 4 | Signal | 2629 | 6597 |
| NM_004225 | MFHAS1 | malignant fibrous histiocytoma amplified sequence 1 | GTP-binding | 2630 | 6598 |
| NM_004235 | KLF4 | Kruppel-like factor 4 (gut) | Transcription regulation, Activator, Zinc-finger, Metal-binding, DNA-binding, Nuclear protein, Repeat | 2631 | 6599 |
| NM_004239 | TRIP11 | thyroid hormone receptor interactor 11 | Hypothetical protein, Antigen, Golgi stack, Coiled coil, Chromosomal translocation | 2632 | 6600 |
| NM_004244 | CD163 | CD163 antigen | Signal, Antigen | 2633 | 6601 |
| NM_004245 | TGM5 | transglutaminase 5 | Transferase, Acyltransferase, Calcium-binding, Polymorphism, Alternative splicing | 2634 | 6602 |
| NM_004252 | SLC9A3R1 | solute carrier family 9 (sodium/hydrogen exchanger), isoform 3 regulatory factor 1 | | 2635 | 6603 |
| NM_004255 | COX5A | cytochrome c oxidase subunit Va | Oxidoreductase, Heme, Mitochondrion, Inner membrane, Transit peptide | 2636 | 6604 |
| NM_004258 | IGSF2 | immunoglobulin superfamily, member 2 | | 2637 | 6605 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004263 | SEMA4F | sema domain, immunoglobulin domain (Ig), transmembrane domain (TM) and short cytoplasmic domain, (semaphorin) 4F | Signal, Transmembrane, Immunoglobulin domain, Multigene family, Neurogenesis, Developmental protein, Glycoprotein, Alternative splicing | 2638 | 6606 |
| NM_004265 | FADS2 | fatty acid desaturase 2 | Hypothetical protein, Heme | 2639 | 6607 |
| NM_004272 | HOMER1 | homer homolog 1 (Drosophila) | Coiled coil, Alternative splicing | 2640 | 6608 |
| NM_004279 | PMPCB | peptidase (mitochondrial processing) beta | Chaperone, Nuclear protein, Phosphorylation, Hydrolase, Metalloprotease, Zinc, Mitochondrion, Transit peptide, Hypothetical protein | 2641 | 6609 |
| NM_004295 | TRAF4 | TNF receptor-associated factor 4 | Apoptosis, Developmental protein, Nuclear protein, Zinc-finger, Coiled coil, Repeat, Alternative splicing | 2642 | 6610 |
| NM_004300 | ACP1 | acid phosphatase 1, soluble | Hydrolase, Acetylation, Alternative splicing, Polymorphism, 3D-structure | 2643 | 6611 |
| NM_004305 | BIN1 | bridging integrator 1 | Alternative splicing, SH3 domain, Coiled coil, Endocytosis, Anti-oncogene, Differentiation, Phosphorylation, Hypothetical protein | 2644 | 6612 |
| NM_004309 | ARHGDIA | Rho GDP dissociation inhibitor (GDI) alpha | GTPase activation, 3D-structure | 2645 | 6613 |
| NM_004313 | ARRB2 | arrestin, beta 2 | Sensory transduction, Nuclear protein, Alternative splicing | 2646 | 6614 |
| NM_004331 | BNIP3L | BCL2/adenovirus E1B 19 kDa interacting protein 3-like | Apoptosis, Transmembrane, Mitochondrion | 2647 | 6615 |
| NM_004334 | BST1 | bone marrow stromal cell antigen 1 | Hydrolase, NAD, Glycoprotein, GPI-anchor, Signal, 3D-structure, Lipoprotein, Hypothetical protein | 2648 | 6616 |
| NM_004336 | BUB1 | BUB1 budding uninhibited by benzimidazoles 1 homolog (yeast) | Transferase, Serine/threonine-protein kinase, ATP-binding, Cell cycle, Nuclear protein, Mitosis, Phosphorylation, Polymorphism | 2649 | 6617 |
| NM_004337 | C8orf1 | chromosome 8 open reading frame 1 | Meiosis | 2650 | 6618 |
| NM_004345 | CAMP | cathelicidin antimicrobial peptide | Antibiotic, Signal, Pyrrolidone carboxylic acid | 2651 | 6619 |
| NM_004350 | RUNX3 | runt-related transcription factor 3 | Transcription regulation, DNA-binding, Nuclear protein, ATP-binding, Alternative splicing | 2652 | 6620 |
| NM_004358 | CDC25B | cell division cycle 25B | Cell division, Mitosis, Hydrolase, Alternative splicing, Multigene family, 3D-structure | 2653 | 6621 |
| NM_004360 | CDH1 | cadherin 1, type 1, E-cadherin (epithelial) | Elongation factor, Protein biosynthesis, GTP-binding, Methylation, Multigene family, Ribosomal protein, Repeat, Hypothetical protein, Cell adhesion, Glycoprotein, Transmembrane, Calcium-binding, Signal, Phosphorylation, Disease mutation, Polymorphism, 3D-structure | 2654 | 6622 |
| NM_004368 | CNN2 | calponin 2 | Calmodulin-binding, Actin-binding, Multigene family, Repeat | 2655 | 6623 |
| NM_004374 | COX6C | cytochrome c oxidase subunit VIc | Oxidoreductase, Inner membrane, Mitochondrion | 2656 | 6624 |
| NM_004375 | COX11 | COX11 homolog, cytochrome c oxidase assembly protein (yeast) | Copper, Mitochondrion, Transmembrane, Transit peptide, Transport, Protein transport, SH3-binding, Membrane, Golgi stack, Phosphorylation, Hypothetical protein | 2657 | 6625 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004380 | CREBBP | CREB binding protein (Rubinstein-Taybi syndrome) | Transferase, Transcription regulation, Nuclear protein, Activator, Bromodomain, Chromosomal translocation, Zinc-finger, Repeat, Disease mutation, 3D-structure | 2658 | 6626 |
| NM_004381 | CREBL1 | cAMP responsive element binding protein-like 1 | Glycoprotein, Cell adhesion, Repeat, EGF-like domain, Coiled coil, Extracellular matrix, Alternative splicing, Signal, Ehlers-Danlos syndrome, Transcription regulation, DNA-binding, Activator, Unfolded protein response, Nuclear protein, Endoplasmic reticu | 2659 | 6627 |
| NM_004385 | CSPG2 | chondroitin sulfate proteoglycan 2 (versican) | Glycoprotein, Proteoglycan, Lectin, Extracellular matrix, Sushi, Signal, Repeat, EGF-like domain, Calcium, Immunoglobulin domain, Hyaluronic acid, Alternative splicing | 2660 | 6628 |
| NM_004390 | CTSH | cathepsin H | Hydrolase, Protease, Thiol protease, Lysosome, Glycoprotein, Zymogen, Signal, 3D-structure | 2661 | 6629 |
| NM_004398 | DDX10 | DEAD (Asp-Glu-Ala-Asp) box polypeptide 10 | Helicase, ATP-binding, RNA-binding | 2662 | 6630 |
| NM_004409 | DMPK | dystrophia myotonica-protein kinase | Transferase, Serine/threonine-protein kinase, ATP-binding, Coiled coil, Alternative splicing | 2663 | 6631 |
| NM_004417 | DUSP1 | dual specificity phosphatase 1 | Hydrolase, Cell cycle | 2664 | 6632 |
| NM_004418 | DUSP2 | dual specificity phosphatase 2 | Hydrolase, Nuclear protein, 3D-structure | 2665 | 6633 |
| NM_004424 | E4F1 | E4F transcription factor 1 | Metal-binding, Zinc, Zinc-finger | 2666 | 6634 |
| NM_004427 | PHC2 | polyhomeotic-like 2 (*Drosophila*) | Hypothetical protein | 2667 | 6635 |
| NM_004446 | EPRS | glutamyl-prolyl-tRNA synthetase | Aminoacyl-tRNA synthetase, Protein biosynthesis, Ligase, ATP-binding, Multifunctional enzyme, Repeat, 3D-structure | 2668 | 6636 |
| NM_004450 | ERH | enhancer of rudimentary homolog (*Drosophila*) | | 2669 | 6637 |
| NM_004453 | ETFDH | electron-transferring-flavoprotein dehydrogenase | Oxidoreductase, Electron transport, Flavoprotein, FAD, Iron-sulfur, 4Fe—4S, Mitochondrion, Transit peptide, Ubiquinone, Transmembrane, Glutaricaciduria | 2670 | 6638 |
| NM_004475 | FLOT2 | flotillin 2 | Cell adhesion, Membrane | 2671 | 6639 |
| NM_004477 | FRG1 | FSHD region gene 1 | Multigene family | 2672 | 6640 |
| NM_004479 | FUT7 | fucosyltransferase 7 (alpha (1, 3) fucosyltransferase) | Transferase, Glycosyltransferase, Transmembrane, Glycoprotein, Signal-anchor, Golgi stack | 2673 | 6641 |
| NM_004480 | FUT8 | fucosyltransferase 8 (alpha (1, 6) fucosyltransferase) | Transferase, Glycosyltransferase, Transmembrane, Signal-anchor, Golgi stack, SH3 domain, SH3-binding, Alternative splicing | 2674 | 6642 |
| NM_004482 | GALNT3 | UDP-N-acetyl-alpha-D-galactosamine:polypeptide N-acetylgalactosaminyl transferase 3 (GalNAc-T3) | Transferase | 2675 | 6643 |
| NM_004483 | GCSH | glycine cleavage system protein H (aminomethyl carrier) | Mitochondrion, Transit peptide, Lipoyl | 2676 | 6644 |
| NM_004485 | GNG4 | guanine nucleotide binding protein (G protein), gamma 4 | Transducer, Prenylation, Lipoprotein, Multigene family | 2677 | 6645 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004489 | GPS2 | G protein pathway suppressor 2 | Hypothetical protein | 2678 | 6646 |
| NM_004492 | GTF2A2 | general transcription factor IIA, 2, 12 kDa | Transcription regulation, Nuclear protein | 2679 | 6647 |
| NM_004497 | FOXA3 | forkhead box A3 | DNA-binding, Nuclear protein, Transcription regulation, Activator, Polymorphism | 2680 | 6648 |
| NM_004504 | HRB | HIV-1 Rev binding protein | Nuclear protein, Transport, Repeat, DNA-binding, Zinc-finger | 2681 | 6649 |
| NM_004506 | HSF2 | heat shock transcription factor 2 | Heat shock, Transcription regulation, Nuclear protein, DNA-binding, Activator, Phosphorylation, Multigene family | 2682 | 6650 |
| NM_004513 | IL16 | interleukin 16 (lymphocyte chemoattractant factor) | Cytokine, Chemotaxis, Repeat, 3D-structure | 2683 | 6651 |
| NM_004515 | ILF2 | interleukin enhancer binding factor 2, 45 kDa | | 2684 | 6652 |
| NM_004516 | ILF3 | interleukin enhancer binding factor 3, 90 kDa | Hypothetical protein, Transcription regulation, DNA-binding, RNA-binding, Nuclear protein, Repeat, Phosphorylation, Methylation, Alternative splicing | 2685 | 6653 |
| NM_004524 | LLGL2 | lethal giant larvae homolog 2 (Drosophila) | Repeat, WD repeat | 2686 | 6654 |
| NM_004529 | MLLT3 | myeloid/lymphoid or mixed-lineage leukemia (trithorax homolog, Drosophila); translocated to, 3 | Transcription regulation, Activator, Nuclear protein, Chromosomal translocation, Proto-oncogene | 2687 | 6655 |
| NM_004537 | NAP1L1 | nucleosome assembly protein 1-like 1 | Nuclear protein | 2688 | 6656 |
| NM_004554 | NFATC4 | nuclear factor of activated T-cells, cytoplasmic, calcineurin-dependent 4 | Hypothetical protein, Transcription regulation, Activator, Nuclear protein, DNA-binding, Repeat, Phosphorylation | 2689 | 6657 |
| NM_004563 | PCK2 | phosphoenolpyruvate carboxykinase 2 (mitochondrial) | Gluconeogenesis, Lyase, Decarboxylase, GTP-binding, Mitochondrion, Transit peptide, Manganese | 2690 | 6658 |
| NM_004566 | PFKFB3 | 6-phosphofructo-2-kinase/fructose-2,6-biphosphatase 3 | Kinase, Hydrolase, Multifunctional enzyme, Transferase, ATP-binding, Phosphorylation, Multigene family, Alternative splicing | 2691 | 6659 |
| NM_004569 | PIGH | phosphatidylinositol glycan, class H | Hypothetical protein, Transferase, Glycosyltransferase | 2692 | 6660 |
| NM_004573 | PLCB2 | phospholipase C, beta 2 | Hydrolase, Lipid degradation, Transducer, Calcium | 2693 | 6661 |
| NM_004578 | RAB4A | RAB4A, member RAS oncogene family | GTP-binding, Lipoprotein, Prenylation, Protein transport, Phosphorylation | 2694 | 6662 |
| NM_004580 | RAB27A | RAB27A, member RAS oncogene family | GTP-binding, Lipoprotein, Prenylation, Alternative splicing, Disease mutation | 2695 | 6663 |
| NM_004583 | RAB5C | RAB5C, member RAS oncogene family | GTP-binding, Lipoprotein, Prenylation, Protein transport | 2696 | 6664 |
| NM_004603 | STX1A | syntaxin 1A (brain) | Neurotransmitter transport, Coiled coil, Transmembrane, Antigen, Alternative splicing, Williams-Beuren syndrome | 2697 | 6665 |
| NM_004618 | TOP3A | topoisomerase (DNA) III alpha | Isomerase, Topoisomerase, DNA-binding, Repeat, Zinc-finger, Alternative splicing, Polymorphism | 2698 | 6666 |
| NM_004629 | FANCG | Fanconi anemia, complementation group G | DNA repair, Nuclear protein | 2699 | 6667 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004632 | DAP3 | death associated protein 3 | Apoptosis, Ribosomal protein, Mitochondrion | 2700 | 6668 |
| NM_004633 | IL1R2 | interleukin 1 receptor, type II | Immunoglobulin domain, Receptor, Glycoprotein, Transmembrane, Signal, Repeat | 2701 | 6669 |
| NM_004635 | MAPKAPK3 | mitogen-activated protein kinase-activated protein kinase 3 | ATP-binding, Kinase, Serine/threonine-protein kinase, Transferase | 2702 | 6670 |
| NM_004637 | RAB7 | RAB7, member RAS oncogene family | GTP-binding, Lipoprotein, Prenylation, Protein transport, Hypothetical protein | 2703 | 6671 |
| NM_004642 | CDK2AP1 | CDK2-associated protein 1 | Anti-oncogene | 2704 | 6672 |
| NM_004648 | PTPNS1 | protein tyrosine phosphatase, non-receptor type substrate 1 | Repeat, Signal, Transmembrane, Immunoglobulin domain, SH3-binding, Glycoprotein, Phosphorylation, Alternative splicing, Polymorphism | 2705 | 6673 |
| NM_004651 | USP11 | ubiquitin specific protease 11 | Ubl conjugation pathway, Hydrolase, Thiol protease, Nuclear protein, Multigene family | 2706 | 6674 |
| NM_004664 | LIN7A | lin-7 homolog A (C. elegans) | | 2707 | 6675 |
| NM_004665 | VNN2 | vanin 2 | Hydrolase, Signal, Glycoprotein, GPI-anchor, Lipoprotein | 2708 | 6676 |
| NM_004666 | VNN1 | vanin 1 | Hydrolase, Signal, Glycoprotein, GPI-anchor, Lipoprotein | 2709 | 6677 |
| NM_004668 | MGAM | maltase-glucoamylase (alpha-glucosidase) | Multifunctional enzyme, Transmembrane, Glycoprotein, Hydrolase, Glycosidase, Repeat, Signal-anchor, Sulfation | 2710 | 6678 |
| NM_004682 | PSIP2 | PC4 and SFRS1 interacting protein 1 | | 2711 | 6679 |
| NM_004689 | MTA1 | metastasis associated 1 | Zinc-finger, Nuclear protein, Alternative splicing | 2712 | 6680 |
| NM_004694 | SLC16A6 | solute carrier family 16 (monocarboxylic acid transporters), member 6 | Transport, Symport, Transmembrane, Multigene family | 2713 | 6681 |
| NM_004706 | ARHGEF1 | Rho guanine nucleotide exchange factor (GEF) 1 | Guanine-nucleotide releasing factor, GTPase activation, Coiled coil, Alternative splicing, Phosphorylation, 3D-structure | 2714 | 6682 |
| NM_004708 | PDCD5 | programmed cell death 5 | Apoptosis | 2715 | 6683 |
| NM_004712 | HGS | hepatocyte growth factor-regulated tyrosine kinase substrate | Kinase | 2716 | 6684 |
| NM_004720 | EDG4 | endothelial differentiation, lysophosphatidic acid G-protein-coupled receptor, 4 | G-protein coupled receptor, Transmembrane, Glycoprotein, Multigene family, Lipoprotein, Palmitate | 2717 | 6685 |
| NM_004726 | REPS2 | RALBP1 associated Eps domain containing 2 | Calcium-binding, Coiled coil, Phosphorylation, Alternative splicing, Repeat, 3D-structure | 2718 | 6686 |
| NM_004727 | SLC24A1 | solute carrier family 24 (sodium/potassium/calcium exchanger), member 1 | Vision, Transport, Antiport, Symport, Calcium transport, Transmembrane, Glycoprotein, Phosphorylation, Signal, Repeat, Alternative splicing | 2719 | 6687 |
| NM_004729 | ALTE | Ac-like transposable element | | 2720 | 6688 |
| NM_004741 | NOLC1 | nucleolar and coiled-body phosphoprotein 1 | Nuclear protein, Phosphorylation, Repeat, GTP-binding, ATP-binding, Alternative splicing | 2721 | 6689 |
| NM_004748 | CPR8 | cell cycle progression 8 protein | Hypothetical protein | 2722 | 6690 |
| NM_004749 | CPR2 | cell cycle progression 2 protein | Hypothetical protein | 2723 | 6691 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004756 | NUMBL | numb homolog (*Drosophila*)-like | | 2724 | 6692 |
| NM_004757 | SCYE1 | small inducible cytokine subfamily E, member 1 (endothelial monocyte-activating) | Protein biosynthesis, RNA-binding, tRNA-binding, Cytokine, 3D-structure | 2725 | 6693 |
| NM_004762 | PSCD1 | pleckstrin homology, Sec7 and coiled-coil domains 1 (cytohesin 1) | Guanine-nucleotide releasing factor, Coiled coil, Alternative splicing, 3D-structure | 2726 | 6694 |
| NM_004774 | PPARBP | PPAR binding protein | DNA-binding, Transcription regulation, Activator, Repeat, Nuclear protein, Alternative splicing | 2727 | 6695 |
| NM_004779 | CNOT8 | CCR4-NOT transcription complex, subunit 8 | Coiled coil, Nuclear protein, Alternative splicing, Hypothetical protein, Molybdenum cofactor biosynthesis, Disease mutation, Transcription regulation, Repressor | 2728 | 6696 |
| NM_004781 | VAMP3 | vesicle-associated membrane protein 3 (cellubrevin) | Synapse, Synaptosome, Transmembrane, Coiled coil, Multigene family | 2729 | 6697 |
| NM_004786 | TXNL | thioredoxin-like, 32 kDa | Redox-active center, Electron transport, 3D-structure | 2730 | 6698 |
| NM_004800 | TM9SF2 | transmembrane 9 superfamily member 2 | Signal, Transmembrane | 2731 | 6699 |
| NM_004802 | OTOF | otoferlin | Transmembrane, Repeat, Alternative splicing, Deafness | 2732 | 6700 |
| NM_004808 | NMT2 | N-myristoyltransferase 2 | Transferase, Acyltransferase | 2733 | 6701 |
| NM_004814 | HPRP8BP | U5 snRNP-specific 40 kDa protein (hPrp8-binding) | Repeat, WD repeat, Hypothetical protein | 2734 | 6702 |
| NM_004817 | TJP2 | tight junction protein 2 (zona occludens 2) | Tight junction, SH3 domain, Repeat, Membrane, Alternative splicing, Alternative promoter usage, Nuclear protein, Phosphorylation | 2735 | 6703 |
| NM_004834 | MAP4K4 | mitogen-activated protein kinase kinase kinase kinase 4 | ATP-binding, Serine/threonine-protein kinase, Transferase, Alternative splicing | 2736 | 6704 |
| NM_004848 | C1orf38 | chromosome 1 open reading frame 38 | Hypothetical protein | 2737 | 6705 |
| NM_004854 | CHST10 | carbohydrate sulfotransferase 10 | Transferase | 2738 | 6706 |
| NM_004856 | KIF23 | anaphase-promoting complex subunit 7 | Motor protein, Cell division, Microtubule, ATP-binding, Coiled coil, Mitosis, Cell cycle, Nuclear protein | 2739 | 6707 |
| NM_004862 | LITAF | lipopolysaccharide-induced TNF factor | Hypothetical protein, Transcription regulation, Nuclear protein | 2740 | 6708 |
| NM_004868 | GPSN2 | glycoprotein, synaptic 2 | Transmembrane, Glycoprotein, Alternative splicing | 2741 | 6709 |
| NM_004875 | POLR1C | polymerase (RNA) I polypeptide C, 30 kDa | Hypothetical protein, Transferase, DNA-directed RNA polymerase, Transcription, Nuclear protein, Alternative splicing | 2742 | 6710 |
| NM_004877 | GMFG | glia maturation factor, gamma | Growth factor, Ribosomal protein | 2743 | 6711 |
| NM_004878 | PTGES | prostaglandin E synthase | Hypothetical protein, Transmembrane | 2744 | 6712 |
| NM_004879 | EI24 | etoposide induced 2.4 mRNA | | 2745 | 6713 |
| NM_004889 | ATP5J2 | ATP synthase, H+ transporting, mitochondrial F0 complex, subunit f, isoform 2 | ATP synthesis, Hydrogen ion transport, CF(0), Mitochondrion, Acetylation, Alternative splicing | 2746 | 6714 |
| NM_004900 | APOBEC3B | apolipoprotein B mRNA editing enzyme, catalytic polypeptide-like 3B | Hydrolase | 2747 | 6715 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_004900 | RNPC2 | RNA-binding region (RNP1, RRM) containing 2 | Transcription regulation, Activator, Nuclear protein, RNA-binding, mRNA-processing, mRNA splicing, Repeat, Alternative splicing, Polymorphism | 2748 | 6716 |
| NM_004905 | PRDX6 | peroxiredoxin 6 | Hydrolase, Oxidoreductase, Peroxidase, Lipid degradation, Antioxidant, Redox-active center, Multifunctional enzyme, Lysosome, 3D-structure | 2749 | 6717 |
| NM_004907 | ETR101 | immediate early protein | ATP-binding, Coiled coil, Microtubules, Motor protein | 2750 | 6718 |
| NM_004910 | PITPNM1 | phosphatidylinositol transfer protein, membrane-associated 1 | Hypothetical protein | 2751 | 6719 |
| NM_004915 | ABCG1 | ATP-binding cassette, sub-family G (WHITE), member 1 | ATP-binding, Transport, Hypothetical protein, Lipid transport, Transmembrane, Alternative splicing, Polymorphism | 2752 | 6720 |
| NM_004916 | WWOX | Human oxidoreductase (HHCMA56) mRNA, complete cds. | Oxidoreductase | 2753 | 6721 |
| NM_004920 | AATK | apoptosis-associated tyrosine kinase | Kinase, Hypothetical protein, ATP-binding, Transferase | 2754 | 6722 |
| NM_004924 | ACTN4 | actinin, alpha 4 | Actin-binding, Calcium-binding, Repeat, Multigene family, Disease mutation, Nuclear protein, Hypothetical protein | 2755 | 6723 |
| NM_004928 | C21orf2 | chromosome 21 open reading frame 2 | Alternative splicing, Polymorphism | 2756 | 6724 |
| NM_004930 | CAPZB | capping protein (actin filament) muscle Z-line, beta | Cytoskeleton, Actin-binding, Alternative splicing, Actin capping | 2757 | 6725 |
| NM_004939 | DDX1 | DEAD (Asp-Glu-Ala-Asp) box polypeptide 1 | Hydrolase, ATP-binding, Helicase, RNA-binding | 2758 | 6726 |
| NM_004945 | DNM2 | dynamin 2 | Hydrolase, Motor protein, GTP-binding, Microtubule, Multigene family, Endocytosis, Alternative splicing, Hypothetical protein | 2759 | 6727 |
| NM_004954 | MARK2 | MAP/microtubule affinity-regulating kinase 2 | ATP-binding, Kinase, Serine/threonine-protein kinase, Transferase | 2760 | 6728 |
| NM_004974 | KCNA2 | potassium voltage-gated channel, shaker-related subfamily, member 2 | Transport, Ion transport, Ionic channel, Voltage-gated channel, Potassium channel, Potassium transport, Potassium, Transmembrane, Glycoprotein, Phosphorylation, Multigene family | 2761 | 6729 |
| NM_004979 | KCND1 | potassium voltage-gated channel, Shal-related subfamily, member 1 | Transport, Ion transport, Ionic channel, Voltage-gated channel, Potassium channel, Potassium transport, Potassium, Transmembrane, Multigene family | 2762 | 6730 |
| NM_004994 | MMP9 | matrix metalloproteinase 9 (gelatinase B, 92 kDa gelatinase, 92 kDa type IV collagenase) | Hydrolase, Metalloprotease, Glycoprotein, Zinc, Zymogen, Calcium, Collagen degradation, Extracellular matrix, Repeat, Signal, Polymorphism, 3D-structure | 2763 | 6731 |
| NM_005000 | NDUFA5 | NADH dehydrogenase (ubiquinone) 1 alpha subcomplex, 5, 13 kDa | Hypothetical protein, Oxidoreductase, NAD, Ubiquinone, Mitochondrion, Acetylation | 2764 | 6732 |
| NM_005003 | NDUFAB1 | NADH dehydrogenase (ubiquinone) 1, alpha/beta subcomplex, 1, 8 kDa | Fatty acid biosynthesis, Phosphopantetheine, Mitochondrion, Transit peptide, Oxidoreductase | 2765 | 6733 |
| NM_005009 | NME4 | non-metastatic cells 4, protein expressed in | Transferase, Kinase, ATP-binding, Mitochondrion, Transit peptide, 3D-structure | 2766 | 6734 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005011 | NRF1 | nuclear respiratory factor 1 | Transcription regulation, DNA-binding, Activator, Nuclear protein, Phosphorylation, Alternative splicing | 2767 | 6735 |
| NM_005022 | PFN1 | profilin 1 | Actin-binding, Cytoskeleton, Multigene family, Acetylation, 3D-structure | 2768 | 6736 |
| NM_005024 | SERPINB10 | serine (or cysteine) proteinase inhibitor, clade B (ovalbumin), member 10 | Serpin, Serine protease inhibitor | 2769 | 6737 |
| NM_005025 | SERPINI1 | serine (or cysteine) proteinase inhibitor, clade I (neuroserpin), member 1 | Serpin, Serine protease inhibitor, Glycoprotein, Signal, Disease mutation | 2770 | 6738 |
| NM_005026 | PIK3CD | phosphoinositide-3-kinase, catalytic, delta polypeptide | Kinase, Transferase, Multigene family | 2771 | 6739 |
| NM_005029 | PITX3 | paired-like homeodomain transcription factor 3 | Homeobox, DNA-binding, Developmental protein, Nuclear protein, Disease mutation | 2772 | 6740 |
| NM_005030 | PLK | polo-like kinase (*Drosophila*) | Transferase, Serine/threonine-protein kinase, ATP-binding, Repeat, Nuclear protein, Phosphorylation | 2773 | 6741 |
| NM_005040 | PRCP | prolylcarboxypeptidase (angiotensinase C) | Hydrolase, Carboxypeptidase, Glycoprotein, Zymogen, Signal, Lysosome | 2774 | 6742 |
| NM_005044 | PRKX | protein kinase, X-linked | ATP-binding, Kinase, Serine/threonine-protein kinase, Transferase, Tyrosine-protein kinase, cAMP | 2775 | 6743 |
| NM_005055 | RAPSN | receptor-associated protein of the synapse, 43 kD | Synapse, Postsynaptic membrane, Cytoskeleton, Phosphorylation, Myristate, Zinc-finger, Repeat, TPR repeat, Alternative splicing, Lipoprotein, Metal-binding, Receptor | 2776 | 6744 |
| NM_005056 | RBBP2 | retinoblastoma binding protein 2 | Trans-acting factor, Nuclear protein, Repeat, Zinc-finger | 2777 | 6745 |
| NM_005061 | RPL3L | ribosomal protein L3-like | Ribosomal protein | 2778 | 6746 |
| NM_005066 | SFPQ | splicing factor proline/glutamine rich (polypyrimidine tract binding protein associated) | Nuclear protein, RNA-binding, DNA-binding, mRNA splicing, Repeat, Alternative splicing | 2779 | 6747 |
| NM_005084 | PLA2G7 | phospholipase A2, group VII (platelet-activating factor acetylhydrolase, plasma) | Hydrolase, Lipid degradation, Glycoprotein, Signal, Polymorphism, Disease mutation | 2780 | 6748 |
| NM_005085 | NUP214 | nucleoporin 214 kDa | Hypothetical protein, Repeat, WD repeat, Nuclear protein, Transport, Proto-oncogene, Chromosomal translocation, Glycoprotein | 2781 | 6749 |
| NM_005091 | PGLYRP | peptidoglycan recognition protein | Antibiotic, Immune response, Signal | 2782 | 6750 |
| NM_005096 | ZNF261 | zinc finger protein 261 | Hypothetical protein, Chromosomal translocation, Transmembrane, Alternative splicing | 2783 | 6751 |
| NM_005099 | ADAMTS4 | a disintegrin-like and metalloprotease (reprolysin type) with thrombospondin type 1 motif, 4 | Hydrolase, Metalloprotease, Zinc, Signal, Glycoprotein, Zymogen, Extracellular matrix, Hypothetical protein | 2784 | 6752 |
| NM_005106 | DLEC1 | deleted in lung and esophageal cancer 1 | Hypothetical protein | 2785 | 6753 |
| NM_005111 | CRYZL1 | crystallin, zeta (quinone reductase)-like 1 | Oxidoreductase, NADP, Alternative splicing | 2786 | 6754 |
| NM_005112 | WDR1 | WD repeat domain 1 | Repeat, WD repeat, Hypothetical protein, Actin-binding, Cytoskeleton, Alternative splicing, Polymorphism | 2787 | 6755 |
| NM_005134 | PPP4R1 | protein phosphatase 4, regulatory subunit 1 | Hypothetical protein | 2788 | 6756 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005137 | DGCR2 | DiGeorge syndrome critical region gene 2 | Cell adhesion, Receptor, Signal, Transmembrane, Lectin, Glycoprotein | 2789 | 6757 |
| NM_005139 | ANXA3 | annexin A3 | Annexin, Calcium/phospholipid-binding, Repeat, Phospholipase A2 inhibitor, 3D-structure, Polymorphism | 2790 | 6758 |
| NM_005143 | HP | haptoglobin | Glycoprotein, Serine protease homolog, Sushi, Hemoglobin-binding, Signal, Repeat, Polymorphism | 2791 | 6759 |
| NM_005148 | UNC119 | unc-119 homolog (*C. elegans*) | Vision, Alternative splicing | 2792 | 6760 |
| NM_005151 | USP14 | ubiquitin specific protease 14 (tRNA-guanine transglycosylase) | Ubl conjugation pathway, Hydrolase, Thiol protease, Multigene family | 2793 | 6761 |
| NM_005165 | ALDOC | aldolase C, fructose-bisphosphate | Lyase, Schiff base, Glycolysis, Multigene family | 2794 | 6762 |
| NM_005167 | ARHC | hypothetical protein MGC19531 | DNA condensation, Mitosis, Cell cycle, ATP-binding, Coiled coil, Nuclear protein, Alternative splicing, Hypothetical protein, Proto-oncogene, GTP-binding, Prenylation, Lipoprotein | 2795 | 6763 |
| NM_005173 | ATP2A3 | ATPase, Ca++ transporting, ubiquitous | Hydrolase, Calcium transport, Transmembrane, Phosphorylation, ATP-binding, Metal-binding, Magnesium, Calcium-binding, Multigene family, Alternative splicing | 2796 | 6764 |
| NM_005174 | ATP5C1 | ATP synthase, H+ transporting, mitochondrial F1 complex, gamma polypeptide 1 | ATP synthesis, CF(1), Hydrogen ion transport, Hydrolase, Mitochondrion, Transit peptide, Alternative splicing, Hypothetical protein | 2797 | 6765 |
| NM_005180 | BMI1 | B lymphoma Mo-MLV insertion region (mouse) | Chromatin regulator, Nuclear protein, Transcription regulation, Repressor, Zinc-finger, Proto-oncogene | 2798 | 6766 |
| NM_005185 | CALML3 | calmodulin-like 3 | Calcium-binding, Repeat, Methylation, 3D-structure | 2799 | 6767 |
| NM_005190 | CCNC | cyclin C | Cyclin, Cell cycle, Cell division, Nuclear protein, Transcription regulation | 2800 | 6768 |
| NM_005195 | CEBPD | KIAA0146 protein | Transcription regulation, Activator, DNA-binding, Nuclear protein | 2801 | 6769 |
| NM_005197 | CHES1 | checkpoint suppressor 1 | Transcription regulation, Activator, DNA-binding, Nuclear protein, Alternative splicing | 2802 | 6770 |
| NM_005199 | CHRNG | cholinergic receptor, nicotinic, gamma polypeptide | Receptor, Postsynaptic membrane, Ionic channel, Glycoprotein, Signal, Transmembrane | 2803 | 6771 |
| NM_005213 | CSTA | cystatin A (stefin A) | Thiol protease inhibitor, 3D-structure | 2804 | 6772 |
| NM_005217 | DEFA3 | defensin, alpha 3, neutrophil-specific | Defensin, Antibiotic, Antiviral, Fungicide, Signal, 3D-structure | 2805 | 6773 |
| NM_005224 | DRIL1 | dead ringer-like 1 (*Drosophila*) | Transcription regulation, Activator, DNA-binding, Nuclear protein | 2806 | 6774 |
| NM_005231 | EMS1 | ems1 sequence (mammary tumor and squamous cell carcinoma-associated (p80/85 src substrate) | Phosphorylation, Repeat, SH3 domain, Cytoskeleton | 2807 | 6775 |
| NM_005239 | ETS2 | v-ets erythroblastosis virus E26 oncogene homolog 2 (avian) | Proto-oncogene, DNA-binding, Nuclear protein | 2808 | 6776 |
| NM_005248 | FGR | Gardner-Rasheed feline sarcoma viral (v-fgr) oncogene homolog | Transferase, Tyrosine-protein kinase, Proto-oncogene, ATP-binding, Phosphorylation, SH2 domain, SH3 domain | 2809 | 6777 |
| NM_005252 | FOS | v-fos FBJ murine osteosarcoma viral oncogene homolog | Proto-oncogene, Nuclear protein, Phosphorylation, DNA-binding, 3D-structure | 2810 | 6778 |
| NM_005253 | FOSL2 | FOS-like antigen 2 | Nuclear protein, DNA-binding | 2811 | 6779 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005255 | GAK | cyclin G associated kinase | Transferase, Serine/threonine-protein kinase, ATP-binding, Nuclear protein, Endoplasmic reticulum, Cell cycle | 2812 | 6780 |
| NM_005256 | GAS2 | growth arrest-specific 2 | Growth arrest, Phosphorylation, Apoptosis, Cell cycle, Cytoskeleton | 2813 | 6781 |
| NM_005263 | GFI1 | growth factor independent 1 | Transcription regulation, Zinc-finger, DNA-binding, Nuclear protein, Metal-binding, Repeat, Disease mutation | 2814 | 6782 |
| NM_005270 | GLI2 | GLI-Kruppel family member GLI2 | Transcription regulation, Zinc-finger, Metal-binding, DNA-binding, Nuclear protein, Repeat, Alternative splicing | 2815 | 6783 |
| NM_005271 | GLUD1 | glutamate dehydrogenase 1 | Oxidoreductase, NADP, Mitochondrion, Transit peptide, Polymorphism, Disease mutation, Multigene family, 3D-structure | 2816 | 6784 |
| NM_005273 | GNB2 | guanine nucleotide binding protein (G protein), beta polypeptide 2 | Transducer, Repeat, WD repeat, Multigene family | 2817 | 6785 |
| NM_005274 | GNG5 | guanine nucleotide binding protein (G protein), gamma 5 | Transducer, Prenylation, Lipoprotein, Multigene family | 2818 | 6786 |
| NM_005286 | GPR8 | G protein-coupled receptor 8 | Transcription regulation, Zinc-finger, DNA-binding, Nuclear protein, Repeat, G-protein coupled receptor, Transmembrane, Glycoprotein, Lipoprotein, Palmitate, Phosphorylation, Polymorphism | 2819 | 6787 |
| NM_005291 | GPR17 | G protein-coupled receptor 17 | G-protein coupled receptor, Transmembrane, Glycoprotein, Alternative splicing, Receptor | 2820 | 6788 |
| NM_005327 | HADHSC | L-3-hydroxyacyl-Coenzyme A dehydrogenase, short chain | Fatty acid metabolism, Oxidoreductase, NAD, Mitochondrion, Transit peptide, 3D-structure | 2821 | 6789 |
| NM_005335 | HCLS1 | hematopoietic cell-specific Lyn substrate 1 | Repeat, SH3 domain, Phosphorylation | 2822 | 6790 |
| NM_005340 | HINT1 | histidine triad nucleotide binding protein 1 | Hydrolase, Acetylation, 3D-structure | 2823 | 6791 |
| NM_005345 | HSPA1A | heat shock 70 kDa protein 1A | ATP-binding, Chaperone, Heat shock, Multigene family, 3D-structure | 2824 | 6792 |
| NM_005346 | HSPA1B | heat shock 70 kDa protein 1B | ATP-binding, Chaperone, Heat shock, Multigene family, 3D-structure | 2825 | 6793 |
| NM_005357 | LIPE | lipase, hormone-sensitive | Hydrolase, Lipid degradation, Phosphorylation | 2826 | 6794 |
| NM_005358 | LMO7 | LIM domain only 7 | LIM domain, Metal-binding, Zinc, Hypothetical protein, Zinc-finger | 2827 | 6795 |
| NM_005360 | MAF | v-maf musculoaponeurotic fibrosarcoma oncogene homolog (avian) | Proto-oncogene, Transcription regulation, DNA-binding, Nuclear protein, Alternative splicing, Chromosomal translocation | 2828 | 6796 |
| NM_005379 | MYO1A | myosin IA | Myosin, Actin-binding, ATP-binding, Calmodulin-binding, Repeat, Multigene family, Polymorphism, Disease mutation, Deafness | 2829 | 6797 |
| NM_005381 | NCL | nucleolin | Hypothetical protein | 2830 | 6798 |
| NM_005402 | RALA | v-ral simian leukemia viral oncogene homolog A (ras related) | GTP-binding, Prenylation, Lipoprotein | 2831 | 6799 |
| NM_005428 | VAV1 | vav 1 oncogene | Hypothetical protein, SH3 domain, Proto-oncogene, Phorbol-ester binding, Zinc, SH2 domain, Guanine-nucleotide releasing factor, Repeat, Phosphorylation | 2832 | 6800 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005433 | YES1 | v-yes-1 Yamaguchi sarcoma viral oncogene homolog 1 | Proto-oncogene, Tyrosine-protein kinase, Phosphorylation, Transferase, ATP-binding, Myristate, SH3 domain, SH2 domain, Lipoprotein | 2833 | 6801 |
| NM_005436 | D10S170 | DNA segment on chromosome 10 (unique) 170 | Proto-oncogene, Chromosomal translocation, SH3-binding, Repeat | 2834 | 6802 |
| NM_005439 | MLF2 | myeloid leukemia factor 2 | Nuclear protein | 2835 | 6803 |
| NM_005441 | CHAF1B | chromatin assembly factor 1, subunit B (p60) | DNA replication, DNA repair, Cell cycle, Nuclear protein, Phosphorylation, Repeat, WD repeat | 2836 | 6804 |
| NM_005451 | ENIGMA | enigma (LIM domain protein) | LIM domain, Metal-binding, Zinc | 2837 | 6805 |
| NM_005463 | HNRPDL | heterogeneous nuclear ribonucleoprotein D-like | Nucleocapsid, Ribonucleoprotein | 2838 | 6806 |
| NM_005466 | MED6 | mediator of RNA polymerase II transcription, subunit 6 homolog (yeast) | Transcription regulation, Activator, Receptor, Nuclear protein | 2839 | 6807 |
| NM_005472 | KCNE3 | potassium voltage-gated channel, lsk-related family, member 3 | Transport, Ion transport, Ionic channel, Voltage-gated channel, Potassium channel, Potassium, Potassium transport, Transmembrane, Glycoprotein, Disease mutation | 2840 | 6808 |
| NM_005479 | FRAT1 | frequently rearranged in advanced T-cell lymphomas | Wnt signaling pathway, Proto-oncogene, 3D-structure | 2841 | 6809 |
| NM_005480 | TROAP | trophinin associated protein (tastin) | Cell adhesion, Repeat, Cytoskeleton | 2842 | 6810 |
| NM_005488 | TOM1 | target of myb1 (chicken) | Hypothetical protein, Transport, Protein transport, Membrane, 3D-structure | 2843 | 6811 |
| NM_005490 | SH2D3A | SH2 domain containing 3A | Hypothetical protein | 2844 | 6812 |
| NM_005498 | AP1M2 | adaptor-related protein complex 1, mu 2 subunit | Golgi stack, Protein transport, Transport, Coated pits, Endocytosis, Phosphorylation, Alternative splicing | 2845 | 6813 |
| NM_005499 | UBA2 | SUMO-1 activating enzyme subunit 2 | Cyclin, Hypothetical protein | 2846 | 6814 |
| NM_005501 | ITGA3 | integrin, alpha 3 (antigen CD49C, alpha 3 subunit of VLA-3 receptor) | Integrin, Cell adhesion, Receptor, Glycoprotein, Transmembrane, Signal, Phosphorylation, Repeat, Alternative splicing, Calcium | 2847 | 6815 |
| NM_005504 | BCAT1 | branched chain aminotransferase 1, cytosolic | Transferase, Aminotransferase, Branched-chain amino acid biosynthesis, Pyridoxal phosphate, Hypothetical protein | 2848 | 6816 |
| NM_005505 | SCARB1 | scavenger receptor class B, member 1 | Transcription regulation, Nuclear protein, Receptor, Transmembrane, Glycoprotein, Polymorphism, Alternative splicing | 2849 | 6817 |
| NM_005507 | CFL1 | cofilin 1 (non-muscle) | Nuclear protein, Actin-binding, Cytoskeleton, Phosphorylation | 2850 | 6818 |
| NM_005510 | DOM3Z | dom-3 homolog Z (C. elegans) | Transferase, Serine/threonine-protein kinase, ATP-binding, Manganese, Nuclear protein, Alternative splicing | 2851 | 6819 |
| NM_005512 | GARP | glycoprotein A repetitions predominant | Glycoprotein, Leucine-rich repeat, Repeat, Transmembrane, Signal | 2852 | 6820 |
| NM_005514 | HLA-B | major histocompatibility complex, class I, B | Glycoprotein, MHC I, Signal, Transmembrane, Polymorphism, 3D-structure, Alternative splicing, Hypothetical protein, Sulfation | 2853 | 6821 |
| NM_005516 | HLA-E | major histocompatibility complex, class I, E | Glycoprotein, Transmembrane, Hypothetical protein, MHC I, Signal, Polymorphism, 3D-structure | 2854 | 6822 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005517 | HMGN2 | high-mobility group nucleosomal binding domain 2 | Hypothetical protein, Microtubule, GTP-binding, Multigene family, Nuclear protein, DNA-binding, Polymorphism | 2855 | 6823 |
| NM_005527 | HSPA1L | heat shock 70 kDa protein 1-like | ATP-binding, Multigene family, Polymorphism | 2856 | 6824 |
| NM_005534 | IFNGR2 | interferon gamma receptor 2 (interferon gamma transducer 1) | Receptor, Transmembrane, Glycoprotein, Signal, Repeat | 2857 | 6825 |
| NM_005541 | INPP5D | inositol polyphosphate-5-phosphatase, 145 kDa | | 2858 | 6826 |
| NM_005548 | KARS | lysyl-tRNA synthetase | Aminoacyl-tRNA synthetase, Protein biosynthesis, Ligase, ATP-binding, Polymorphism | 2859 | 6827 |
| NM_005564 | LCN2 | lipocalin 2 (oncogene 24p3) | Glycoprotein, Lipocalin, Signal, 3D-structure, Pyrrolidone carboxylic acid | 2860 | 6828 |
| NM_005565 | LCP2 | lymphocyte cytosolic protein 2 (SH2 domain containing leukocyte protein of 76 kDa) | SH2 domain, Phosphorylation | 2861 | 6829 |
| NM_005574 | LMO2 | LIM domain only 2 (rhombotin-like 1) | Proto-oncogene, Repeat, LIM domain, Metal-binding, Zinc, Nuclear protein, Alternative splicing, Chromosomal translocation | 2862 | 6830 |
| NM_005578 | LPP | LIM domain containing preferred translocation partner in lipoma | LIM domain, Metal-binding, Zinc | 2863 | 6831 |
| NM_005586 | MDFI | MyoD family inhibitor | Differentiation | 2864 | 6832 |
| NM_005590 | MRE11A | MRE11 meiotic recombination 11 homolog A (S. cerevisiae) | DNA repair, Hydrolase, Nuclease, Endonuclease, Exonuclease, Nuclear protein, Manganese, Meiosis, Alternative splicing, Disease mutation, Polymorphism, Hypothetical protein | 2865 | 6833 |
| NM_005598 | NHLH1 | nescient helix loop helix 1 | DNA-binding, Transcription regulation, Differentiation | 2866 | 6834 |
| NM_005601 | NKG7 | natural killer cell group 7 sequence | Transmembrane | 2867 | 6835 |
| NM_005605 | PPP3CC | protein phosphatase 3 (formerly 2B), catalytic subunit, gamma isoform (calcineurin A gamma) | Hypothetical protein, Hydrolase, Iron, Manganese, Calmodulin-binding, Metal-binding, Zinc, Multigene family | 2868 | 6836 |
| NM_005607 | PTK2 | PTK2 protein tyrosine kinase 2 | Hypothetical protein, ATP-binding, Transferase, Kinase, Tyrosine-protein kinase, Phosphorylation, Alternative splicing, 3D-structure | 2869 | 6837 |
| NM_005608 | PTPRCAP | protein tyrosine phosphatase, receptor type, C-associated protein | Transmembrane, Phosphorylation | 2870 | 6838 |
| NM_005611 | RBL2 | retinoblastoma-like 2 (p130) | ATP-binding, Kinase, Serine/threonine-protein kinase, Transferase, Transcription regulation, DNA-binding, Nuclear protein, Cell cycle, Phosphorylation, Anti-oncogene | 2871 | 6839 |
| NM_005620 | S100A11 | S100 calcium binding protein A11 (calgizzarin) | Calcium-binding | 2872 | 6840 |
| NM_005621 | S100A12 | S100 calcium binding protein A12 (calgranulin C) | Calcium-binding, Zinc, Metal-binding, Antibiotic, Fungicide, 3D-structure | 2873 | 6841 |
| NM_005623 | CCL8 | chemokine (C—C motif) ligand 8 | Cytokine, Chemotaxis, Signal, Heparin-binding, Inflammatory response, Polymorphism, Pyrrolidone carboxylic acid, 3D-structure | 2874 | 6842 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005625 | SDCBP | syndecan binding protein (syntenin) | Cytoskeleton, Membrane, Endoplasmic reticulum, Nuclear protein, Phosphorylation, Repeat, Polymorphism | 2875 | 6843 |
| NM_005646 | TARBP1 | TAR (HIV) RNA binding protein 1 | | 2876 | 6844 |
| NM_005647 | TBL1X | transducin (beta)-like 1X-linked | Repeat, WD repeat | 2877 | 6845 |
| NM_005654 | NR2F1 | nuclear receptor subfamily 2, group F, member 1 | Receptor, Transcription regulation, DNA-binding, Nuclear protein, Zinc-finger, Activator | 2878 | 6846 |
| NM_005658 | TRAF1 | TNF receptor-associated factor 1 | Apoptosis, Coiled coil | 2879 | 6847 |
| NM_005687 | FRSB | phenylalanyl-tRNA synthetase beta-subunit | Aminoacyl-tRNA synthetase, Protein biosynthesis, Ligase, ATP-binding | 2880 | 6848 |
| NM_005690 | DNM1L | dynamin 1-like | Hypothetical protein | 2881 | 6849 |
| NM_005697 | SCAMP2 | secretory carrier membrane protein 2 | Transmembrane, Transport, Protein transport, Multigene family | 2882 | 6850 |
| NM_005704 | PTPRU | protein tyrosine phosphatase, receptor type, U | Glycoprotein, Hydrolase, Receptor, Repeat, Signal, Transmembrane, Immunoglobulin domain | 2883 | 6851 |
| NM_005710 | PQBP1 | polyglutamine binding protein 1 | Nuclear protein | 2884 | 6852 |
| NM_005713 | COL4A3BP | collagen, type IV, alpha 3 (Goodpasture antigen) binding protein | Transferase, Kinase, Serine/threonine-protein kinase, Coiled coil, Alternative splicing | 2885 | 6853 |
| NM_005716 | RGS19IP1 | regulator of G-protein signalling 19 interacting protein 1 | | 2886 | 6854 |
| NM_005717 | ARPC5 | actin related protein 2/3 complex, subunit 5, 16 kDa | Cytoskeleton | 2887 | 6855 |
| NM_005720 | ARPC1B | actin related protein 2/3 complex, subunit 1B, 41 kDa | Hypothetical protein, Repeat, WD repeat, Polymorphism | 2888 | 6856 |
| NM_005724 | TSPAN-3 | transmembrane 4 superfamily member 8 | Glycoprotein, Transmembrane | 2889 | 6857 |
| NM_005725 | TSPAN-2 | tetraspan 2 | Glycoprotein, Transmembrane | 2890 | 6858 |
| NM_005730 | OS4 | CTD (carboxy-terminal domain, RNA polymerase II, polypeptide A) small phosphatase 2 | Hypothetical protein, Nuclear protein | 2891 | 6859 |
| NM_005731 | ARPC2 | actin related protein 2/3 complex, subunit 2, 34 kDa | Cytoskeleton | 2892 | 6860 |
| NM_005732 | RAD50 | RAD50 homolog (S. cerevisiae) | | 2893 | 6861 |
| NM_005733 | KIF20A | kinesin family member 20A | Motor protein, Microtubule, ATP-binding, Coiled coil, Golgi stack, Protein transport, Transport | 2894 | 6862 |
| NM_005736 | ACTR1A | ARP1 actin-related protein 1 homolog A, centractin alpha (yeast) | Structural protein, Cytoskeleton, Multigene family | 2895 | 6863 |
| NM_005737 | ARL7 | ADP-ribosylation factor-like 7 | GTP-binding, Multigene family, Nuclear protein | 2896 | 6864 |
| NM_005741 | ZNF263 | zinc finger protein 263 | Transcription regulation, Zinc-finger, Metal-binding, Nuclear protein, DNA-binding, Repeat, Repressor | 2897 | 6865 |
| NM_005759 | ABI-2 | abl-interactor 2 | Kinase, SH3 domain | 2898 | 6866 |
| NM_005761 | PLXNC1 | plexin C1 | | 2899 | 6867 |
| NM_005762 | TRIM28 | tripartite motif-containing 28 | Transcription regulation, Repressor, Nuclear protein, Zinc-finger, Repeat, 3D-structure | 2900 | 6868 |
| NM_005770 | SERF2 | small EDRK-rich factor 2 | Hypothetical protein | 2901 | 6869 |
| NM_005771 | RDHL | dehydrogenase/reductase (SDR family) member 9 | Oxidoreductase | 2902 | 6870 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005772 | PLAA | RNA terminal phosphate cyclase-like 1 | Repeat, WD repeat, Hypothetical protein, Nuclear protein | 2903 | 6871 |
| NM_005773 | ZNF256 | zinc finger protein 256 | Transcription regulation, DNA-binding, Zinc-finger, Metal-binding, Nuclear protein, Repeat | 2904 | 6872 |
| NM_005787 | NOT56L | asparagine-linked glycosylation 3 homolog (yeast, alpha-1,3-mannosyltransferase) | Hypothetical protein, Transferase, Glycosyltransferase, Transmembrane, Endoplasmic reticulum, Disease mutation | 2905 | 6873 |
| NM_005797 | EVA1 | epithelial V-like antigen 1 | Cell adhesion, Immunoglobulin domain, Transmembrane, Glycoprotein, Signal | 2906 | 6874 |
| NM_005803 | FLOT1 | flotillin 1 | Membrane | 2907 | 6875 |
| NM_005805 | PSMD14 | proteasome (prosome, macropain) 26S subunit, non-ATPase, 14 | Proteasome | 2908 | 6876 |
| NM_005811 | GDF11 | growth differentiation factor 11 | Growth factor, Cytokine, Glycoprotein, Signal | 2909 | 6877 |
| NM_005826 | HNRPR | heterogeneous nuclear ribonucleoprotein R | Nucleocapsid, Ribonucleoprotein, Nuclear protein, RNA-binding, Repeat | 2910 | 6878 |
| NM_005833 | RAB9P40 | Rab9 effector p40 | | 2911 | 6879 |
| NM_005834 | TIMM17B | translocase of inner mitochondrial membrane 17 homolog B (yeast) | Transport, Protein transport, Translocation, Mitochondrion, Inner membrane, Transmembrane | 2912 | 6880 |
| NM_005836 | UK114 | translational inhibitor protein p14.5 | Nuclear protein | 2913 | 6881 |
| NM_005845 | ABCC4 | ATP-binding cassette, sub-family C (CFTR/MRP), member 4 | ATP-binding, Glycoprotein, Transmembrane, Transport, Repeat | 2914 | 6882 |
| NM_005849 | IGSF6 | immunoglobulin superfamily, member 6 | Signal, Hypothetical protein | 2915 | 6883 |
| NM_005855 | RAMP1 | receptor (calcitonin) activity modifying protein 1 | Signal, Transmembrane, Transport, Receptor | 2916 | 6884 |
| NM_005860 | FSTL3 | follistatin-like 3 (secreted glycoprotein) | Glycoprotein, Repeat, Signal, Chromosomal translocation, Proto-oncogene | 2917 | 6885 |
| NM_005862 | STAG1 | stromal antigen 1 | Mitosis, Cell cycle, Chromosome partition, Nuclear protein, Phosphorylation | 2918 | 6886 |
| NM_005863 | NET1 | neuroepithelial cell transforming gene 1 | | 2919 | 6887 |
| NM_005865 | PRSS16 | protease, serine, 16 (thymus) | Hydrolase, Serine protease, Signal | 2920 | 6888 |
| NM_005866 | SR-BP1 | opioid receptor, sigma 1 | Hypothetical protein, Receptor | 2921 | 6889 |
| NM_005873 | RGS19 | regulator of G-protein signalling 19 | Signal transduction inhibitor, Membrane, Lipoprotein, Palmitate, Phosphorylation, Autophagy, 3D-structure | 2922 | 6890 |
| NM_005874 | LILRB2 | leukocyte immunoglobulin-like receptor, subfamily B (with TM and ITIM domains), member 2 | Receptor, Repeat, Signal, Transmembrane, Immune response, Immunoglobulin domain, Phosphorylation, Glycoprotein, Antigen, Multigene family, Alternative splicing, Polymorphism | 2923 | 6891 |
| NM_005884 | PAK4 | p21(CDKN1A)-activated kinase 4 | Hypothetical protein, ATP-binding, Transferase, Serine/threonine-protein kinase, Phosphorylation, Alternative splicing | 2924 | 6892 |
| NM_005886 | KATNB1 | katanin p80 (WD repeat containing) subunit B 1 | Repeat, WD repeat | 2925 | 6893 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005888 | SLC25A3 | solute carrier family 25 (mitochondrial carrier; phosphate carrier), member 3 | Mitochondrion, Inner membrane, Repeat, Transit peptide, Transmembrane, Transport, Symport, Alternative splicing, Hypothetical protein | 2926 | 6894 |
| NM_005891 | ACAT2 | acetyl-Coenzyme A acetyltransferase 2 (acetoacetyl Coenzyme A thiolase) | Chaperone, ATP-binding, Multigene family, Transferase | 2927 | 6895 |
| NM_005892 | FMNL | formin-like 1 | Hypothetical protein | 2928 | 6896 |
| NM_005898 | M11S1 | membrane component, chromosome 11, surface marker 1 | GPI-anchor | 2929 | 6897 |
| NM_005900 | MADH1 | MAD, mothers against decapentaplegic homolog 1 (*Drosophila*) | Transcription regulation, Phosphorylation, Multigene family, 3D-structure | 2930 | 6898 |
| NM_005902 | MADH3 | MAD, mothers against decapentaplegic homolog 3 (*Drosophila*) | Transcription regulation, Phosphorylation, Multigene family, 3D-structure | 2931 | 6899 |
| NM_005917 | MDH1 | malate dehydrogenase 1, NAD (soluble) | Oxidoreductase, Tricarboxylic acid cycle, NAD | 2932 | 6900 |
| NM_005931 | MICB | MHC class I polypeptide-related sequence B | Glycoprotein, Transmembrane, MHC | 2933 | 6901 |
| NM_005932 | MIPEP | mitochondrial intermediate peptidase | Hydrolase, Metalloprotease, Zinc, Transit peptide, Mitochondrion, Magnesium, Manganese, Calcium, Cobalt, Iron | 2934 | 6902 |
| NM_005935 | MLLT2 | myeloid/lymphoid or mixed-lineage leukemia (trithorax homolog, *Drosophila*); translocated to, 2 | Alternative splicing, Chromosomal translocation, Proto-oncogene, DNA-binding, Bromodomain, Nuclear protein, Zinc-finger, Metal-binding, Transcription regulation, Repeat, Hypothetical protein, Serine/threonine-protein kinase, Transferase, ATP-binding, Tran | 2935 | 6903 |
| NM_005950 | MT1G | metallothionein 1G | Metal-binding, Metal-thiolate cluster, Zinc, Copper, Cadmium, Acetylation | 2936 | 6904 |
| NM_005952 | MT1X | metallothionein 1X | Hypothetical protein, Metal-binding, Metal-thiolate cluster, Zinc, Copper, Cadmium, Acetylation | 2937 | 6905 |
| NM_005953 | MT2A | metallothionein 2A | Metal-binding, Metal-thiolate cluster, Zinc, Acetylation, 3D-structure | 2938 | 6906 |
| NM_005954 | MT3 | metallothionein 3 (growth inhibitory factor (neurotrophic)) | Metal-binding, Metal-thiolate cluster, Zinc, Copper, Acetylation | 2939 | 6907 |
| NM_005955 | MTF1 | metal-regulatory transcription factor 1 | Hypothetical protein, Metal-binding, Zinc, Zinc-finger | 2940 | 6908 |
| NM_005965 | MYLK | myosin, light polypeptide kinase | Immunoglobulin domain, Kinase, ATP-binding, Repeat, Serine/threonine-protein kinase, Transferase, Calmodulin-binding, Phosphorylation, Alternative initiation, Alternative splicing | 2941 | 6909 |
| NM_005969 | NAP1L4 | nucleosome assembly protein 1-like 4 | Nuclear protein | 2942 | 6910 |
| NM_005975 | PTK6 | PTK6 protein tyrosine kinase 6 | Transferase, Tyrosine-protein kinase, ATP-binding, SH2 domain, SH3 domain, Phosphorylation | 2943 | 6911 |
| NM_005979 | S100A13 | S100 calcium binding protein A13 | Calcium-binding | 2944 | 6912 |
| NM_005980 | S100P | S100 calcium binding protein P | Calcium-binding, Placenta, 3D-structure | 2945 | 6913 |
| NM_005988 | SPRR2A | small proline-rich protein 2A | Keratinocyte, Repeat, Multigene family | 2946 | 6914 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_005990 | STK10 | serine/threonine kinase 10 | Kinase, Transferase, Serine/threonine-protein kinase, ATP-binding, Phosphorylation, Coiled coil | 2947 | 6915 |
| NM_005998 | CCT3 | chaperonin containing TCP1, subunit 3 (gamma) | Chaperone, ATP-binding, Multigene family, Hypothetical protein | 2948 | 6916 |
| NM_006002 | UCHL3 | ubiquitin carboxyl-terminal esterase L3 (ubiquitin thiolesterase) | Ubl conjugation pathway, Hydrolase, Thiol protease, Multigene family, 3D-structure | 2949 | 6917 |
| NM_006018 | HM74 | putative chemokine receptor | G-protein coupled receptor, Transmembrane | 2950 | 6918 |
| NM_006019 | TCIRG1 | T-cell, immune regulator 1, ATPase, H+ transporting, lysosomal V0 protein a isoform 3 | Hydrogen ion transport, Transmembrane, Glycoprotein, Alternative splicing, Hypothetical protein | 2951 | 6919 |
| NM_006022 | TSC22 | transforming growth factor beta-stimulated protein TSC-22 | Hypothetical protein, Transcription regulation, Repressor, Nuclear protein | 2952 | 6920 |
| NM_006027 | EXO1 | exonuclease 1 | Exonuclease, Hypothetical protein | 2953 | 6921 |
| NM_006029 | PNMA1 | paraneoplastic antigen MA1 | Antigen, Tumor antigen, Nuclear protein | 2954 | 6922 |
| NM_006031 | PCNT2 | pericentrin 2 (kendrin) | Coiled coil, Hypothetical protein | 2955 | 6923 |
| NM_006034 | TP53I11 | tumor protein p53 inducible protein 11 | Hypothetical protein | 2956 | 6924 |
| NM_006053 | TCIRG1 | T-cell, immune regulator 1, ATPase, H+ transporting, lysosomal V0 protein a isoform 3 | Hydrogen ion transport, Transmembrane, Glycoprotein, Alternative splicing, Hypothetical protein | 2957 | 6925 |
| NM_006054 | RTN3 | reticulon 3 | Hypothetical protein, Transmembrane, Endoplasmic reticulum | 2958 | 6926 |
| NM_006055 | LANCL1 | LanC lantibiotic synthetase component C-like 1 (bacterial) | Transmembrane | 2959 | 6927 |
| NM_006060 | ZNFN1A1 | zinc finger protein, subfamily 1A, 1 (Ikaros) | Transcription regulation, Activator, Zinc-finger, Metal-binding, DNA-binding, Nuclear protein, Repeat, Alternative splicing | 2960 | 6928 |
| NM_006061 | SGP28 | cysteine-rich secretory protein 3 | Glycoprotein, Signal, Multigene family, Polymorphism | 2961 | 6929 |
| NM_006069 | MRVI1 | murine retrovirus integration site 1 homolog | | 2962 | 6930 |
| NM_006070 | TFG | TRK-fused gene | Hypothetical protein, Ligase, GMP biosynthesis, Purine biosynthesis, ATP-binding, Glutamine amidotransferase | 2963 | 6931 |
| NM_006079 | CITED2 | Cbp/p300-interacting transactivator, with Glu/Asp-rich carboxy-terminal domain, 2 | Transcription regulation, Nuclear protein, Alternative splicing | 2964 | 6932 |
| NM_006088 | TUBB2 | tubulin, beta, 2 | Microtubule, GTP-binding, Multigene family, Hypothetical protein | 2965 | 6933 |
| NM_006093 | PRG3 | proteoglycan 3 | | 2966 | 6934 |
| NM_006097 | MYL9 | myosin, light polypeptide 9, regulatory | Myosin, Calcium-binding, Muscle protein, Phosphorylation, Acetylation, Multigene family | 2967 | 6935 |
| NM_006103 | WFDC2 | WAP four-disulfide core domain 2 | Serine protease inhibitor, Repeat, Signal, Glycoprotein, Alternative splicing | 2968 | 6936 |
| NM_006107 | LUC7A | acid-inducible phosphoprotein | Phosphorylation, Hypothetical protein | 2969 | 6937 |
| NM_006109 | SKB1 | SKB1 homolog (S. pombe) | Transferase, Methyltransferase, Alternative splicing | 2970 | 6938 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006111 | ACAA2 | acetyl-Coenzyme A acyltransferase 2 (mitochondrial 3-oxoacyl-Coenzyme A thiolase) | Acyltransferase, Transferase, Fatty acid metabolism, Mitochondrion, Transit peptide | 2971 | 6939 |
| NM_006113 | VAV3 | vav 3 oncogene | SH3 domain, Phorbol-ester binding, Zinc, SH2 domain, Repeat, Guanine-nucleotide releasing factor, Alternative splicing | 2972 | 6940 |
| NM_006115 | PRAME | preferentially expressed antigen in melanoma | Antigen | 2973 | 6941 |
| NM_006117 | PECI | peroxisomal D3,D2-enoyl-CoA isomerase | Isomerase, Hypothetical protein, Peroxisome | 2974 | 6942 |
| NM_006135 | CAPZA1 | capping protein (actin filament) muscle Z-line, alpha 1 | Actin-binding, Multigene family, 3D-structure, Actin capping | 2975 | 6943 |
| NM_006138 | MS4A3 | membrane-spanning 4-domains, subfamily A, member 3 (hematopoietic cell-specific) | Receptor, Transmembrane, Alternative splicing, Multigene family | 2976 | 6944 |
| NM_006139 | CD28 | CD28 antigen (Tp44) | Immunoglobulin domain, T-cell, Glycoprotein, Signal, Transmembrane, Alternative splicing | 2977 | 6945 |
| NM_006140 | CSF2RA | colony stimulating factor 2 receptor, alpha, low-affinity (granulocyte-macrophage) | Receptor, Transmembrane, Glycoprotein, Signal, Alternative splicing | 2978 | 6946 |
| NM_006142 | SFN | stratifin | Multigene family | 2979 | 6947 |
| NM_006144 | GZMA | granzyme A (granzyme 1, cytotoxic T-lymphocyte-associated serine esterase 3) | Hydrolase, Serine protease, Zymogen, Signal, T-cell, Cytolysis, Apoptosis, 3D-structure | 2980 | 6948 |
| NM_006145 | DNAJB1 | DnaJ (Hsp40) homolog, subfamily B, member 1 | Heat shock, Chaperone, 3D-structure | 2981 | 6949 |
| NM_006147 | IRF6 | interferon regulatory factor 6 | Transcription regulation, DNA-binding, Nuclear protein, Polymorphism, Disease mutation | 2982 | 6950 |
| NM_006148 | LASP1 | LIM and SH3 protein 1 | LIM domain, Metal-binding, Zinc, SH3 domain | 2983 | 6951 |
| NM_006159 | NELL2 | NEL-like 2 (chicken) | EGF-like domain, Glycoprotein, Repeat, Signal | 2984 | 6952 |
| NM_006161 | NEUROG1 | neurogenin 1 | DNA-binding, Nuclear protein, Transcription regulation, Activator, Neurogenesis, Developmental protein, Differentiation | 2985 | 6953 |
| NM_006176 | NRGN | neurogranin (protein kinase C substrate, RC3) | Calmodulin-binding, Phosphorylation, Neurone | 2986 | 6954 |
| NM_006185 | NUMA1 | nuclear mitotic apparatus protein 1 | Immunoglobulin domain, Glycoprotein, Signal, Alternative splicing, Hypothetical protein | 2987 | 6955 |
| NM_006196 | PCBP1 | poly(rC) binding protein 1 | Nuclear protein, RNA-binding, Ribonucleoprotein, DNA-binding, Phosphorylation, Repeat | 2988 | 6956 |
| NM_006202 | PDE4A | phosphodiesterase 4A, cAMP-specific (phosphodiesterase E2 dunce homolog, *Drosophila*) | Hydrolase, cAMP, Alternative splicing, Multigene family | 2989 | 6957 |
| NM_006205 | PDE6H | phosphodiesterase 6H, cGMP-specific, cone, gamma | Hydrolase, cGMP, Vision | 2990 | 6958 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006214 | PHYH | phytanoyl-CoA hydroxylase (Refsum disease) | Oxidoreductase, Peroxisome, Vitamin C, Iron, Transit peptide, Disease mutation, Deafness, Retinitis pigmentosa, Hydrolase, cGMP, Vision, Prenylation, Lipoprotein, Membrane, Hypothetical protein, Collagen | 2991 | 6959 |
| NM_006224 | PITPN | phosphotidylinositol transfer protein | Lipid-binding, Transport | 2992 | 6960 |
| NM_006225 | PLCD1 | phospholipase C, delta 1 | Hydrolase, Lipid degradation, Transducer, Calcium-binding, Repeat | 2993 | 6961 |
| NM_006238 | PPARD | peroxisome proliferative activated receptor, delta | Receptor, Transcription regulation, Activator, DNA-binding, Nuclear protein, Zinc-finger, Multigene family, 3D-structure, Metal-binding | 2994 | 6962 |
| NM_006242 | PPP1R3D | protein phosphatase 1, regulatory subunit 3D | Hydrolase, Glycogen metabolism | 2995 | 6963 |
| NM_006243 | PPP2R5A | protein phosphatase 2, regulatory subunit B (B56), alpha isoform | Phosphorylation, Multigene family | 2996 | 6964 |
| NM_006244 | PPP2R5B | protein phosphatase 2, regulatory subunit B (B56), beta isoform | Phosphorylation, Alternative splicing, Multigene family | 2997 | 6965 |
| NM_006254 | PRKCD | protein kinase C, delta | ATP-binding, Transferase, Scrine/threonine-protein kinase, Phorbol-ester binding, Zinc, Repeat, Polymorphism, Phosphorylation, Membrane | 2998 | 6966 |
| NM_006272 | S100B | S100 calcium binding protein, beta (neural) | Calcium-binding, Zinc, Metal-binding, 3D-structure | 2999 | 6967 |
| NM_006284 | TAF10 | TAF10 RNA polymerase II, TATA box binding protein (TBP)-associated factor, 30 kDa | Transcription regulation, Nuclear protein, Polymorphism | 3000 | 6968 |
| NM_006287 | TFPI | tissue factor pathway inhibitor (lipoprotein-associated coagulation inhibitor) | Serine protease inhibitor, Glycoprotein, Repeat, Blood coagulation, Signal, Alternative splicing, 3D-structure, Polymorphism | 3001 | 6969 |
| NM_006289 | TLN1 | talin 1 | Hypothetical protein, Structural protein, Cytoskeleton | 3002 | 6970 |
| NM_006290 | TNFAIP3 | tumor necrosis factor, alpha-induced protein 3 | Apoptosis, DNA-binding, Zinc-finger, Repeat, Hypothetical protein | 3003 | 6971 |
| NM_006291 | TNFAIP2 | tumor necrosis factor, alpha-induced protein 2 | Angiogenesis | 3004 | 6972 |
| NM_006304 | DSS1 | split hand/foot malformation (ectrodactyly) type 1 | Polymorphism, 3D-structure | 3005 | 6973 |
| NM_006310 | NPEPPS | aminopeptidase puromycin sensitive | Hydrolase, Metalloprotease, Aminopeptidase, Zinc, Nuclear protein | 3006 | 6974 |
| NM_006314 | CNK1 | connector enhancer of KSR-like (Drosophila kinase suppressor of ras) | Hypothetical protein, Kinase | 3007 | 6975 |
| NM_006317 | BASP1 | brain abundant, membrane attached signal protein 1 | Membrane, Myristate, Neurone, Lipoprotein | 3008 | 6976 |
| NM_006319 | CDIPT | CDP-diacylglycerol-inositol 3-phosphatidyltransferase (phosphatidylinositol synthase) | Transferase, Phospholipid biosynthesis, Transmembrane, Magnesium, Manganese | 3009 | 6977 |
| NM_006321 | ARIH2 | ariadne homolog 2 (Drosophila) | Ubl conjugation pathway, Nuclear protein, Coiled coil, Zinc-finger, Repeat | 3010 | 6978 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006323 | SEC24B | SEC24 related gene family, member B (*S. cerevisiae*) | Transport, Protein transport, Golgi stack, Endoplasmic reticulum, Multigene family | 3011 | 6979 |
| NM_006324 | CFDP1 | craniofacial development protein 1 | | 3012 | 6980 |
| NM_006327 | TIMM23 | translocase of inner mitochondrial membrane 23 homolog (yeast) | Transport, Protein transport, Translocation, Mitochondrion, Inner membrane, Outer membrane, Transmembrane | 3013 | 6981 |
| NM_006342 | TACC3 | transforming, acidic coiled-coil containing protein 3 | Coiled coil | 3014 | 6982 |
| NM_006344 | HML2 | C-type (calcium dependent, carbohydrate-recognition domain) lectin, superfamily member 13 (macrophage-derived) | Lectin | 3015 | 6983 |
| NM_006345 | C4orf1 | solute carrier family 30 (zinc transporter), member 9 | Hypothetical protein | 3016 | 6984 |
| NM_006346 | PIBF1 | progesterone-induced blocking factor 1 | | 3017 | 6985 |
| NM_006351 | TIMM44 | translocase of inner mitochondrial membrane 44 homolog (yeast) | Mitochondrion, Inner membrane, Transport, Protein transport, Translocation, Transit peptide, ATP-binding, Receptor | 3018 | 6986 |
| NM_006353 | HMGN4 | high mobility group nucleosomal binding domain 4 | Nuclear protein, DNA-binding | 3019 | 6987 |
| NM_006355 | TRIM38 | tripartite motif-containing 38 | Zinc-finger, Polymorphism | 3020 | 6988 |
| NM_006360 | GA17 | dendritic cell protein | Hypothetical protein | 3021 | 6989 |
| NM_006362 | NXF1 | nuclear RNA export factor 1 | Transport, mRNA transport, Nuclear protein, RNA-binding, Repeat, Leucine-rich repeat, Multigene family, 3D-structure | 3022 | 6990 |
| NM_006367 | CAP | CAP, adenylate cyclase-associated protein 1 (yeast) | Membrane, Multigene family | 3023 | 6991 |
| NM_006374 | STK25 | serine/threonine kinase 25 (STE20 homolog, yeast) | Hypothetical protein, ATP-binding, Transferase, Serine/threonine-protein kinase, Phosphorylation | 3024 | 6992 |
| NM_006377 | UNC13 | unc-13 homolog B (*C. elegans*) | Phorbol-ester binding | 3025 | 6993 |
| NM_006383 | KIP2 | DNA-dependent protein kinase catalytic subunit-interacting protein 2 | Calcium-binding, Repeat | 3026 | 6994 |
| NM_006386 | DDX17 | DEAD (Asp-Glu-Ala-Asp) box polypeptide 17 | ATP-binding, RNA-binding, Helicase, Nuclear protein | 3027 | 6995 |
| NM_006387 | CHERP | calcium homeostasis endoplasmic reticulum protein | | 3028 | 6996 |
| NM_006389 | HYOU1 | hypoxia up-regulated 1 | ATP-binding, Chaperone, Endoplasmic reticulum, Signal, Glycoprotein | 3029 | 6997 |
| NM_006395 | GSA7 | APG7 autophagy 7-like (*S. cerevisiae*) | Hypothetical protein | 3030 | 6998 |
| NM_006399 | BATF | basic leucine zipper transcription factor, ATF-like | Transcription regulation, DNA-binding, Repressor, Phosphorylation, Nuclear protein | 3031 | 6999 |
| NM_006403 | NEDD9 | neural precursor cell expressed, developmentally down-regulated 9 | Phosphorylation, SH3 domain, Cell adhesion, Growth regulation, Cytoskeleton, Mitosis, Nuclear protein | 3032 | 7000 |
| NM_006404 | PROCR | protein C receptor, endothelial (EPCR) | Blood coagulation, Receptor, Signal, Transmembrane, Glycoprotein, Antigen, Polymorphism, 3D-structure | 3033 | 7001 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006405 | TM9SF1 | transmembrane 9 superfamily member 1 | Hypothetical protein, Plasmid, Signal, Transmembrane, Glycoprotein | 3034 | 7002 |
| NM_006406 | PRDX4 | peroxiredoxin 4 | Antioxidant, Peroxidase, Oxidoreductase, Redox-active center | 3035 | 7003 |
| NM_006421 | BIG1 | brefeldin A-inhibited guanine nucleotide-exchange protein 1 | Guanine-nucleotide releasing factor | 3036 | 7004 |
| NM_006429 | CCT7 | chaperonin containing TCP1, subunit 7 (eta) | Chaperone, ATP-binding, Multigene family | 3037 | 7005 |
| NM_006430 | CCT4 | chaperonin containing TCP1, subunit 4 (delta) | Chaperone, ATP-binding, Multigene family, Hypothetical protein | 3038 | 7006 |
| NM_006431 | CCT2 | chaperonin containing TCP1, subunit 2 (beta) | ATP-binding, Chaperone, Multigene family | 3039 | 7007 |
| NM_006433 | GNLY | granulysin | Antibiotic, Fungicide, Signal, T-cell, Alternative splicing, 3D-structure | 3040 | 7008 |
| NM_006435 | IFITM2 | interferon induced transmembrane protein 2 (1-8D) | Interferon induction, Transmembrane, Polymorphism | 3041 | 7009 |
| NM_006441 | MTHFS | 5,10-methenyltetrahydrofolate synthetase (5-formyltetrahydrofolate cyclo-ligase) | Ligase, Folate-binding, Acetylation, Magnesium, Hypothetical protein | 3042 | 7010 |
| NM_006451 | PAIP1 | poly(A) binding protein interacting protein 1 | Hypothetical protein | 3043 | 7011 |
| NM_006452 | PAICS | phosphoribosylaminoimidazole carboxylase, phosphoribosylaminoimidazole succinocarboxamide synthetase | Multifunctional enzyme, Purine biosynthesis, Ligase, Lyase, Decarboxylase | 3044 | 7012 |
| NM_006455 | SC65 | synaptonemal complex protein SC65 | Nuclear protein, Antigen | 3045 | 7013 |
| NM_006456 | STHM | sialyltransferase | Transferase, Glycosyltransferase, Glycoprotein, Transmembrane, Signal-anchor, Golgi stack | 3046 | 7014 |
| NM_006461 | SPAG5 | sperm associated antigen 5 | Hypothetical protein | 3047 | 7015 |
| NM_006465 | DRIL2 | dead ringer (*Drosophila*)-like 2 (bright and dead ringer) | | 3048 | 7016 |
| NM_006469 | IVNS1ABP | influenza virus NS1A binding protein | Hypothetical protein | 3049 | 7017 |
| NM_006471 | MLC-B | myosin regulatory light chain MRCL3 | Myosin, Calcium-binding, Muscle protein, Phosphorylation, Acetylation, Multigene family | 3050 | 7018 |
| NM_006472 | TXNIP | thioredoxin interacting protein | | 3051 | 7019 |
| NM_006477 | RRP22 | RAS-related on chromosome 22 | GTP-binding, Prenylation, Lipoprotein | 3052 | 7020 |
| NM_006480 | RGS14 | regulator of G-protein signalling 14 | Repeat, Thiol protease inhibitor, Alternative splicing, Phosphorylation, Signal transduction inhibitor | 3053 | 7021 |
| NM_006495 | EVI2B | ecotropic viral integration site 2B | Proto-oncogene, Transmembrane, Glycoprotein, Signal | 3054 | 7022 |
| NM_006542 | SPHAR | S-phase response (cyclin-related) | | 3055 | 7023 |
| NM_006545 | NPR2L | homologous to yeast nitrogen permease (candidate tumor suppressor) | Hypothetical protein | 3056 | 7024 |
| NM_006560 | CUGBP1 | CUG triplet repeat, RNA binding protein 1 | Hypothetical protein, mRNA processing, RNA-binding, Repeat, Nuclear protein, Alternative splicing | 3057 | 7025 |
| NM_006567 | FARS1 | phenylalanine-tRNA synthetase 1 (mitochondrial) | Aminoacyl-tRNA synthetase | 3058 | 7026 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006568 | CGR19 | cell growth regulator with ring finger domain 1 | Metal-binding, Zinc, Zinc-finger | 3059 | 7027 |
| NM_006575 | MAP4K5 | mitogen-activated protein kinase kinase kinase kinase 5 | ATP-binding, Kinase, Transferase, Tyrosine-protein kinase, Serine/threonine-protein kinase | 3060 | 7028 |
| NM_006578 | GNB5 | guanine nucleotide binding protein (G protein), beta 5 | Repeat, WD repeat, Transducer, Alternative splicing, Multigene family, Hypothetical protein | 3061 | 7029 |
| NM_006589 | C1orf2 | chromosome 1 open reading frame 2 | Hypothetical protein | 3062 | 7030 |
| NM_006598 | SLC12A7 | solute carrier family 12 (potassium/chloride transporters), member 7 | Transport, Ion transport, Symport, Potassium, Potassium transport, Transmembrane, Alternative splicing | 3063 | 7031 |
| NM_006636 | MTHFD2 | methylene tetrahydrofolate dehydrogenase (NAD+ dependent), methenyltetrahydrofolate cyclohydrolase | Multifunctional enzyme, One-carbon metabolism, Oxidoreductase, NAD, Hydrolase, Mitochondrion, Transit peptide, Magnesium | 3064 | 7032 |
| NM_006638 | RNASEP1 | ribonuclease P1 | Hydrolase, Nuclear protein, tRNA processing | 3065 | 7033 |
| NM_006643 | SDCCAG3 | serologically defined colon cancer antigen 3 | Hypothetical protein | 3066 | 7034 |
| NM_006644 | HSPH1 | heat shock 105 kDa/110 kDa protein 1 | ATP-binding, Heat shock, Multigene family, Alternative splicing | 3067 | 7035 |
| NM_006646 | WASF3 | WAS protein family, member 3 | Actin-binding, Coiled coil | 3068 | 7036 |
| NM_006650 | CPLX2 | complexin 2 | Neurotransmitter transport | 3069 | 7037 |
| NM_006660 | CLPX | ClpX caseinolytic protease X homolog (E. coli) | Hypothetical protein, ATP-binding, Chaperone, Mitochondrion, Transit peptide, Zinc-finger | 3070 | 7038 |
| NM_006667 | PGRMC1 | progesterone receptor membrane component 1 | Receptor, Steroid-binding, Transmembrane, Microsome | 3071 | 7039 |
| NM_006669 | LILRB1 | leukocyte immunoglobulin-like receptor, subfamily B (with TM and ITIM domains), member 1 | Receptor, Repeat, Signal, Transmembrane, Immune response, Immunoglobulin domain, Phosphorylation, Glycoprotein, Antigen, Multigene family, Alternative splicing, Polymorphism, 3D-structure | 3072 | 7040 |
| NM_006676 | USP20 | ubiquitin specific protease 20 | Ubl conjugation pathway, Hydrolase, Thiol protease, Multigene family | 3073 | 7041 |
| NM_006680 | ME3 | malic enzyme 3, NADP(+)-dependent, mitochondrial | Oxidoreductase, NADP, Mitochondrion, Transit peptide | 3074 | 7042 |
| NM_006681 | NMU | neuromedin U | Neuropeptide, Cleavage on pair of basic residues, Amidation, Signal | 3075 | 7043 |
| NM_006682 | FGL2 | fibrinogen-like 2 | T-cell, Glycoprotein, Signal, Polymorphism | 3076 | 7044 |
| NM_006700 | FLN29 | FLN29 gene product | | 3077 | 7045 |
| NM_006704 | SUGT1 | SGT1, suppressor of G2 allele of SKP1 (S. cerevisiae) | Ubl conjugation pathway, Repeat, TPR repeat | 3078 | 7046 |
| NM_006705 | GADD45G | growth arrest and DNA-damage-inducible, gamma | Differentiation, Apoptosis | 3079 | 7047 |
| NM_006706 | TCERG1 | transcription elongation regulator 1 (CA150) | | 3080 | 7048 |
| NM_006708 | GLO1 | glyoxalase I | Lyase, Zinc, Polymorphism, 3D-structure | 3081 | 7049 |
| NM_006710 | COP9 | COP9 signalosome subunit 8 | | 3082 | 7050 |
| NM_006719 | ABLIM1 | actin binding LIM protein 1 | LIM domain, Metal-binding, Zinc, Hypothetical protein | 3083 | 7051 |
| NM_006721 | ADK | adenosine kinase | Transferase, Kinase, Purine salvage, Magnesium, Alternative splicing, 3D-structure | 3084 | 7052 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006732 | FOSB | FBJ murine osteosarcoma viral oncogene homolog B | Nuclear protein, DNA-binding | 3085 | 7053 |
| NM_006747 | SIPA1 | signal-induced proliferation-associated gene 1 | GTPase activation, Coiled coil, Nuclear protein, Membrane | 3086 | 7054 |
| NM_006748 | SLA | Src-like-adaptor | SH2 domain, SH3 domain, Myristate, Phosphorylation, Lipoprotein | 3087 | 7055 |
| NM_006750 | SNTB2 | syntrophin, beta 2 (dystrophin-associated protein A1, 59 kDa, basic component 2) | Actin-binding, Cytoskeleton, Microtubule, Calcium-binding, Calmodulin-binding, Membrane, Phosphorylation, Repeat, Polymorphism, Multigene family, Alternative splicing | 3088 | 7056 |
| NM_006755 | TALDO1 | transaldolase 1 | Hypothetical protein, Pentose shunt, Transferase, Disease mutation, 3D-structure | 3089 | 7057 |
| NM_006756 | TCEA1 | transcription elongation factor A (SII), 1 | Transcription regulation, Zinc-finger, DNA-binding, Nuclear protein, Alternative splicing, 3D-structure | 3090 | 7058 |
| NM_006760 | UPK2 | uroplakin 2 | Endoplasmic reticulum, Signal, Transmembrane, Glycoprotein | 3091 | 7059 |
| NM_006761 | YWHAE | tyrosine 3-monooxygenase/tryptophan 5-monooxygenase activation protein, epsilon polypeptide | Neurone, Acetylation, Multigene family | 3092 | 7060 |
| NM_006762 | LAPTM5 | Lysosomal-associated multispanning membrane protein-5 | Transmembrane, Lysosome | 3093 | 7061 |
| NM_006763 | BTG2 | BTG family, member 2 | Signal | 3094 | 7062 |
| NM_006770 | MARCO | macrophage receptor with collagenous structure | Collagen, Transmembrane, Receptor, Glycoprotein, Signal-anchor | 3095 | 7063 |
| NM_006783 | GJB6 | gap junction protein, beta 6 (connexin 30) | Gap junction, Transmembrane, Deafness, Disease mutation | 3096 | 7064 |
| NM_006784 | WDR3 | WD repeat domain 3 | WD repeat, Repeat, Nuclear protein | 3097 | 7065 |
| NM_006787 | MAGED2 | melanoma antigen, family D, 2 | Antigen, Multigene family, Polymorphism, Alternative splicing | 3098 | 7066 |
| NM_006795 | EHD1 | EH-domain containing 1 | Calcium-binding, ATP-binding, Coiled coil | 3099 | 7067 |
| NM_006801 | KDELR1 | KDEL (Lys-Asp-Glu-Leu) endoplasmic reticulum protein retention receptor 1 | Endoplasmic reticulum, Transmembrane, Protein transport, Receptor, Hypothetical protein, Transport | 3100 | 7068 |
| NM_006805 | HNRPA0 | heterogeneous nuclear ribonucleoprotein A0 | Nuclear protein, RNA-binding, Ribonucleoprotein, Repeat, Methylation | 3101 | 7069 |
| NM_006806 | BTG3 | BTG family, member 3 | Alternative splicing | 3102 | 7070 |
| NM_006810 | PDIR | for protein disulfide isomerase-related | Isomerase, Redox-active center, Endoplasmic reticulum, Repeat, Signal | 3103 | 7071 |
| NM_006812 | OS-9 | amplified in osteosarcoma | Hypothetical protein, Signal, Alternative splicing, Polymorphism | 3104 | 7072 |
| NM_006818 | AF1Q | ALL1-fused gene from chromosome 1q | Proto-oncogene, Chromosomal translocation | 3105 | 7073 |
| NM_006823 | PKIA | protein kinase (cAMP-dependent, catalytic) inhibitor alpha | Protein kinase inhibitor, 3D-structure | 3106 | 7074 |
| NM_006824 | EBNA1BP2 | EBNA1 binding protein 2 | Ribosome biogenesis, Nuclear protein, Coiled coil | 3107 | 7075 |
| NM_006825 | CKAP4 | cytoskeleton-associated protein 4 | Hypothetical protein | 3108 | 7076 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006826 | YWHAQ | tyrosine 3-monooxygenase/tryptophan 5-monooxygenase activation protein, theta polypeptide | Transcription regulation, Repressor, Activator, Nuclear protein, Zinc-finger, Metal-binding, DNA-binding, Repeat, 3D-structure, Tight junction, Immunoglobulin domain, Glycoprotein, Transmembrane, Signal, Neurone, Phosphorylation, Multigene family | 3109 | 7077 |
| NM_006827 | TMP21 | transmembrane trafficking protein | Transport, Protein transport, Transmembrane, Signal, Glycoprotein, Golgi stack, Polymorphism | 3110 | 7078 |
| NM_006838 | METAP2 | methionyl aminopeptidase 2 | Hydrolase, Aminopeptidase, Cobalt, 3D-structure, Hypothetical protein | 3111 | 7079 |
| NM_006840 | LILRB5 | leukocyte immunoglobulin-like receptor, subfamily B (with TM and ITIM domains), member 2 | Receptor, Repeat, Signal, Transmembrane, Immune response, Immunoglobulin domain, Phosphorylation, Glycoprotein, Antigen, Multigene family, Alternative splicing | 3112 | 7080 |
| NM_006863 | LILRA1 | leukocyte immunoglobulin-like receptor, subfamily B (with TM and ITIM domains), member 1 | Immune response, Receptor, Repeat, Signal, Transmembrane, Immunoglobulin domain, Glycoprotein, Antigen, Alternative splicing, Multigene family | 3113 | 7081 |
| NM_006864 | LILRB3 | leukocyte immunoglobulin-like receptor, subfamily B (with TM and ITIM domains), member 3 | Receptor, Repeat, Signal, Transmembrane, Immune response, Immunoglobulin domain, Phosphorylation, Glycoprotein, Antigen, Multigene family, Alternative splicing, Polymorphism | 3114 | 7082 |
| NM_006865 | LILRA3 | leukocyte immunoglobulin-like receptor, subfamily A (without TM domain), member 3 | Receptor, Repeat, Signal, Immune response, Immunoglobulin domain, Glycoprotein, Antigen, Multigene family, Polymorphism | 3115 | 7083 |
| NM_006866 | LILRA2 | leukocyte immunoglobulin-like receptor, subfamily B (with TM and ITIM domains), member 1 | Immune response, Receptor, Repeat, Signal, Transmembrane, Immunoglobulin domain, Glycoprotein, Antigen, Alternative splicing, Polymorphism, Multigene family | 3116 | 7084 |
| NM_006868 | RAB31 | RAB31, member RAS oncogene family | GTP-binding, Lipoprotein, Prenylation | 3117 | 7085 |
| NM_006869 | CENTA1 | centaurin, alpha 1 | | 3118 | 7086 |
| NM_006876 | B3GNT6 | UDP-GlcNAc:betaGal beta-1,3-N-acetylglucosaminyltransferase 6 | Transferase, Glycosyltransferase, Transmembrane, Signal-anchor, Glycoprotein, Golgi stack | 3119 | 7087 |
| NM_006890 | CEACAM7 | carcinoembryonic antigen-related cell adhesion molecule 7 | Immunoglobulin domain, Antigen, Membrane, Signal, Glycoprotein, Lipoprotein, GPI-anchor, Repeat, Alternative splicing | 3120 | 7088 |
| NM_006892 | DNMT3B | DNA (cytosine-5-)-methyltransferase 3 beta | Transferase, Methyltransferase, Zinc-finger, Zinc, Metal-binding, Nuclear protein, Ubl conjugation, Alternative splicing, Disease mutation | 3121 | 7089 |
| NM_006913 | RNF5 | ring finger protein 5 | Hypothetical protein | 3122 | 7090 |
| NM_006923 | SDF2 | stromal cell-derived factor 2 | Signal, Repeat | 3123 | 7091 |
| NM_006930 | SKP1A | S-phase kinase-associated protein 1A (p19A) | Ubl conjugation pathway, Alternative splicing, 3D-structure | 3124 | 7092 |
| NM_006931 | SLC2A3 | solute carrier family 2 (facilitated glucose transporter), member 3 | Sugar transport, Transmembrane, Transport, Glycoprotein, Multigene family | 3125 | 7093 |
| NM_006932 | SMTN | smoothelin | Structural protein, Alternative splicing | 3126 | 7094 |
| NM_006936 | SMT3H1 | SMT3 suppressor of mif two 3 homolog 1 (yeast) | Ubl conjugation pathway | 3127 | 7095 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_006938 | SNRPD1 | small nuclear ribonucleoprotein D1 polypeptide 16 kDa | Nuclear protein, Ribonucleoprotein, mRNA splicing, mRNA processing, Systemic lupus erythematosus, Repeat, Methylation, 3D-structure | 3128 | 7096 |
| NM_006941 | SOX10 | SRY (sex determining region Y)-box 10 | Transcription regulation, DNA-binding, Nuclear protein, Disease mutation, Hirschsprung disease, Deafness | 3129 | 7097 |
| NM_006945 | SPRR2B | small proline-rich protein 2B | Keratinocyte, Repeat, Multigene family | 3130 | 7098 |
| NM_006947 | SRP72 | signal recognition particle 72 kDa | ATP-binding, Kinase, Transferase, Signal recognition particle, Ribonucleoprotein | 3131 | 7099 |
| NM_006987 | RPH3AL | rabphilin 3A-like (without C2 domains) | Hypothetical protein | 3132 | 7100 |
| NM_006993 | NPM3 | nucleophosmin/nucleoplasmin, 3 | Nuclear protein, Chaperone, Phosphorylation | 3133 | 7101 |
| NM_007000 | UPK1A | uroplakin 1A | Hypothetical protein, Transmembrane, Glycoprotein | 3134 | 7102 |
| NM_007007 | CPSF6 | cleavage and polyadenylation specific factor 6, 68 kDa | | 3135 | 7103 |
| NM_007008 | RTN4 | reticulon 4 | Endoplasmic reticulum, Alternative splicing, Transmembrane, Hypothetical protein | 3136 | 7104 |
| NM_007014 | WWP2 | Nedd-4-like ubiquitin-protein ligase | Ubl conjugation pathway, Ligase, Repeat | 3137 | 7105 |
| NM_007022 | 101F6 | putative tumor suppressor 101F6 | | 3138 | 7106 |
| NM_007024 | PL6 | placental protein 6 | Transmembrane | 3139 | 7107 |
| NM_007032 | HRIHFB2122 | Tara-like protein | Hypothetical protein, Cytoskeleton, Actin-binding, Coiled coil, Nuclear protein | 3140 | 7108 |
| NM_007033 | RER1 | RER1 homolog (*S. cerevisiae*) | Transmembrane, Golgi stack | 3141 | 7109 |
| NM_007034 | DNAJB4 | DnaJ (Hsp40) homolog, subfamily B, member 4 | Chaperone, Heat shock | 3142 | 7110 |
| NM_007043 | HRB2 | HIV-1 rev binding protein 2 | | 3143 | 7111 |
| NM_007054 | KIF3A | kinesin family member 3A | Motor protein, Microtubule, ATP-binding, Coiled coil, Neurone | 3144 | 7112 |
| NM_007056 | SWAP2 | splicing factor, arginine/serine-rich 16 (suppressor-of-white-apricot homolog, *Drosophila*) | mRNA processing, mRNA splicing, Nuclear protein, Alternative splicing, Polymorphism | 3145 | 7113 |
| NM_007059 | KPTN | kaptin (actin binding protein) | | 3146 | 7114 |
| NM_007062 | PWP1 | nuclear phosphoprotein similar to *S. cerevisiae* PWP1 | Repeat, WD repeat, Nuclear protein, Phosphorylation | 3147 | 7115 |
| NM_007063 | TBC1D8 | TBC1 domain family, member 8 (with GRAM domain) | GTPase activation | 3148 | 7116 |
| NM_007065 | CDC37 | CDC37 cell division cycle 37 homolog (*S. cerevisiae*) | Chaperone | 3149 | 7117 |
| NM_007070 | FAP48 | glomulin, FKBP associated protein | Coiled coil, Phosphorylation, Alternative splicing, Disease mutation, Polymorphism | 3150 | 7118 |
| NM_007074 | CORO1A | coronin, actin binding protein, 1A | Actin-binding, Repeat, WD repeat, Coiled coil, Polymorphism | 3151 | 7119 |
| NM_007077 | AP4S1 | adaptor-related protein complex 4, sigma 1 subunit | Coated pits, Endocytosis | 3152 | 7120 |
| NM_007098 | CLTCL1 | clathrin, heavy polypeptide-like 1 | Coated pits, Alternative splicing | 3153 | 7121 |
| NM_007099 | ACP1 | acid phosphatase 1, soluble | Hydrolase, Acetylation, Alternative splicing, Polymorphism, 3D-structure | 3154 | 7122 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_007108 | TCEB2 | transcription elongation factor B (SIII), polypeptide 2 (18 kDa, elongin B) | Transcription regulation, Ubl conjugation pathway, Nuclear protein, 3D-structure | 3155 | 7123 |
| NM_007115 | TNFAIP6 | tumor necrosis factor, alpha-induced protein 6 | Cell adhesion, Signal, Glycoprotein, Polymorphism, 3D-structure | 3156 | 7124 |
| NM_007145 | ZNF146 | zinc finger protein 146 | Zinc-finger, DNA-binding, Metal-binding, Nuclear protein, Repeat | 3157 | 7125 |
| NM_007152 | ZNF195 | zinc finger protein 195 | Zinc-finger, Metal-binding, DNA-binding, Nuclear protein, Alternative splicing | 3158 | 7126 |
| NM_007161 | LST1 | leukocyte specific transcript 1 | Signal, Immune response, Cell shape, Transmembrane, Alternative splicing, Receptor | 3159 | 7127 |
| NM_007169 | PEMT | phosphatidylethanol amine N-methyltransferase | Phospholipid biosynthesis, Transferase, Methyltransferase, Transmembrane, Mitochondrion, Endoplasmic reticulum, Polymorphism | 3160 | 7128 |
| NM_007172 | NUP50 | nucleoporin 50 kDa | Hypothetical protein, Nuclear protein, Transport, Protein transport, Repeat, Porin | 3161 | 7129 |
| NM_007178 | UNRIP | unr-interacting protein | Hypothetical protein, Repeat, WD repeat | 3162 | 7130 |
| NM_007186 | CEP2 | centrosomal protein 2 | Cell cycle, Coiled coil, Phosphorylation, Alternative splicing, Polymorphism | 3163 | 7131 |
| NM_007205 | TREX2 | three prime repair exonuclease 2 | Hypothetical protein, Proteasome, Exonuclease | 3164 | 7132 |
| NM_007208 | MRPL3 | mitochondrial ribosomal protein L3 | Ribosomal protein, Mitochondrion | 3165 | 7133 |
| NM_007212 | RNF2 | ring finger protein 2 | Metal-binding, Zinc, Zinc-finger | 3166 | 7134 |
| NM_007213 | JM4 | JM4 protein | | 3167 | 7135 |
| NM_007219 | RNF24 | ring finger protein 24 | Zinc-finger | 3168 | 7136 |
| NM_007222 | ZHX1 | zinc-fingers and homeoboxes 1 | Homeobox, Metal-binding, Nuclear protein, Zinc, Zinc-finger | 3169 | 7137 |
| NM_007238 | PXMP4 | peroxisomal membrane protein 4, 24 kDa | Peroxisome, Transmembrane, Glycoprotein, Polymorphism | 3170 | 7138 |
| NM_007240 | DUSP12 | dual specificity phosphatase 12 | Hydrolase, Zinc, Metal-binding | 3171 | 7139 |
| NM_007248 | TREX1 | three prime repair exonuclease 1 | Hypothetical protein, Exonuclease | 3172 | 7140 |
| NM_007255 | B4GALT7 | xylosylprotein beta 1,4-galactosyltransferase, polypeptide 7 (galactosyltransferase I) | Glycosyltransferase, Transferase, Glycoprotein, Transmembrane, Signal-anchor, Golgi stack, Multigene family, Disease mutation, Ehlers-Danlos syndrome | 3173 | 7141 |
| NM_007274 | BACH | brain acyl-CoA hydrolase | Hydrolase, Serine esterase, Repeat, Alternative splicing | 3174 | 7142 |
| NM_007278 | GABARAP | GABA(A) receptor-associated protein | Receptor | 3175 | 7143 |
| NM_007284 | PTK9L | protein tyrosine kinase 9-like (A6-related protein) | Hypothetical protein, Kinase | 3176 | 7144 |
| NM_007311 | BZRP | benzodiazapine receptor (peripheral) | Mitochondrion, Receptor, Transmembrane, Polymorphism | 3177 | 7145 |
| NM_007317 | KIF22 | kinesin family member 22 | DNA-binding, Motor protein, Microtubule, ATP-binding, Coiled coil, Nuclear protein | 3178 | 7146 |
| NM_007318 | PSEN1 | presenilin 1 (Alzheimer disease 3) | Transmembrane, Phosphorylation, Endoplasmic reticulum, Golgi stack, Alzheimer's disease, Disease mutation, Polymorphism, Alternative splicing | 3179 | 7147 |
| NM_007320 | RANBP3 | RAN binding protein 3 | Hypothetical protein | 3180 | 7148 |
| NM_007334 | KLRD1 | killer cell lectin-like receptor subfamily D, member 1 | Antigen, Receptor, Glycoprotein, Transmembrane, Signal-anchor, Lectin, Alternative splicing, 3D-structure | 3181 | 7149 |
| NM_007346 | OGFR | opioid growth factor receptor | Receptor, Growth regulation, Repeat, Alternative splicing | 3182 | 7150 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_007360 | D12S2489E | killer cell lectin-like receptor subfamily K, member 1 | Receptor, Transmembrane, Multigene family, Signal-anchor, Lectin, Glycoprotein, Polymorphism, 3D-structure | 3183 | 7151 |
| NM_007375 | TARDBP | TAR DNA binding protein | DNA-binding, RNA-binding, Nuclear protein, Transcription regulation, Repressor, mRNA processing, mRNA splicing, Repeat | 3184 | 7152 |
| NM_009588 | LTB | lymphotoxin beta (TNF superfamily, member 3) | Cytokine, Transmembrane, Glycoprotein, Signal-anchor, Alternative splicing, Polymorphism | 3185 | 7153 |
| NM_012062 | DNM1L | dynamin 1-like | Hypothetical protein | 3186 | 7154 |
| NM_012064 | MIP | major intrinsic protein of lens fiber | Gap junction, Transport, Transmembrane, Phosphorylation, Eye lens protein | 3187 | 7155 |
| NM_012079 | DGAT1 | diacylglycerol O-acyltransferase homolog 1 (mouse) | Transferase, Acyltransferase, Transmembrane, Endoplasmic reticulum, Hypothetical protein | 3188 | 7156 |
| NM_012084 | GLUD2 | glutamate dehydrogenase 2 | Hypothetical protein | 3189 | 7157 |
| NM_012086 | GTF3C3 | general transcription factor IIIC, polypeptide 3, 102 kDa | Hypothetical protein | 3190 | 7158 |
| NM_012089 | ABCB10 | ATP-binding cassette, sub-family B (MDR/TAP), member 10 | ATP-binding, Transmembrane, Transport, Mitochondrion, Inner membrane, Transit peptide, Polymorphism | 3191 | 7159 |
| NM_012094 | PRDX5 | peroxiredoxin 5 | Antioxidant, Peroxisome, Mitochondrion, Transit peptide, Alternative initiation, Polymorphism, 3D-structure | 3192 | 7160 |
| NM_012100 | DNPEP | aspartyl aminopeptidase | Hydrolase, Aminopeptidase, Metalloprotease, Zinc, Hypothetical protein | 3193 | 7161 |
| NM_012108 | BRDG1 | BCR downstream signaling 1 | | 3194 | 7162 |
| NM_012114 | CASP14 | caspase 14, apoptosis-related cysteine protease | Hydrolase, Thiol protease, Apoptosis, Zymogen | 3195 | 7163 |
| NM_012124 | CHORDC1 | cysteine and histidine-rich domain (CHORD)-containing, zinc binding protein 1 | | 3196 | 7164 |
| NM_012130 | CLDN14 | claudin 14 | Tight junction, Transmembrane, Polymorphism, Disease mutation, Deafness | 3197 | 7165 |
| NM_012142 | CCNDBP1 | cyclin D-type binding-protein 1 | Cyclin, Hypothetical protein | 3198 | 7166 |
| NM_012143 | TFIP11 | tuftelin interacting protein 11 | Biomineralization, Nuclear protein, Alternative splicing | 3199 | 7167 |
| NM_012151 | F8A | coagulation factor VIII-associated (intronic transcript) | Hypothetical protein | 3200 | 7168 |
| NM_012168 | FBXO2 | F-box only protein 2 | Ubl conjugation pathway | 3201 | 7169 |
| NM_012185 | FOXE2 | forkhead box E2 | DNA-binding, Nuclear protein, Transcription regulation | 3202 | 7170 |
| NM_012198 | GCA | grancalcin, EF-hand calcium binding protein | Calcium-binding, Repeat, 3D-structure | 3203 | 7171 |
| NM_012203 | GRHPR | glyoxylate reductase/hydroxypyruvate reductase | Hypothetical protein, Oxidoreductase, Pyruvate | 3204 | 7172 |
| NM_012214 | MGAT4A | mannosyl (alpha-1,3-)-glycoprotein beta-1,4-N-acetylglucosaminyltransferase, isoenzyme A | Glycosyltransferase, Transferase | 3205 | 7173 |
| NM_012218 | ILF3 | interleukin enhancer binding factor 3, 90 kDa | Hypothetical protein, Transcription regulation, DNA-binding, RNA-binding, Nuclear protein, Repeat, Phosphorylation, Methylation, Alternative splicing | 3206 | 7174 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_012228 | PILB | pilin-like transcription factor | Hypothetical protein | 3207 | 7175 |
| NM_012229 | NT5C2 | 5'-nucleotidase, cytosolic II | Hydrolase, Allosteric enzyme | 3208 | 7176 |
| NM_012236 | SCMH1 | sex comb on midleg homolog 1 (*Drosophila*) | | 3209 | 7177 |
| NM_012244 | SLC7A8 | solute carrier family 7 (cationic amino acid transporter, y+ system), member 8 | Hypothetical protein, Transport, Amino-acid transport, Transmembrane | 3210 | 7178 |
| NM_012250 | RRAS2 | related RAS viral (r-ras) oncogene homolog 2 | GTP-binding, Prenylation, Lipoprotein, Proto-oncogene, Disease mutation | 3211 | 7179 |
| NM_012255 | XRN2 | 5'-3' exoribonuclease 2 | mRNA processing, Hydrolase, Nuclease, Exonuclease, Nuclear protein, RNA-binding, Zinc-finger | 3212 | 7180 |
| NM_012258 | HEY1 | hairy/enhancer-of-split related with YRPW motif 1 | Hypothetical protein, Transcription regulation, DNA-binding, Nuclear protein | 3213 | 7181 |
| NM_012262 | HS2ST1 | heparan sulfate 2-O-sulfotransferase 1 | Hypothetical protein, Transferase | 3214 | 7182 |
| NM_012282 | KCNE1L | potassium voltage-gated channel, Isk-related family, member 1-like | Transmembrane, Glycoprotein, Alport syndrome, Deafness, Elliptocytosis | 3215 | 7183 |
| NM_012286 | MORF4L2 | mortality factor 4 like 2 | Growth regulation, Nuclear protein | 3216 | 7184 |
| NM_012290 | TLK1 | tousled-like kinase 1 | ATP-binding, Kinase, Serine/threonine-protein kinase, Transferase, Chromatin regulator, Cell cycle, DNA damage, Nuclear protein, Coiled coil, Phosphorylation, Alternative splicing | 3217 | 7185 |
| NM_012295 | CABIN1 | calcineurin binding protein 1 | Hypothetical protein, Phosphorylation, Repeat, TPR repeat | 3218 | 7186 |
| NM_012329 | MMD | monocyte to macrophage differentiation-associated | Transmembrane | 3219 | 7187 |
| NM_012331 | MSRA | methionine sulfoxide reductase A | Oxidoreductase | 3220 | 7188 |
| NM_012341 | CRFG | GTP binding protein 4 | GTP-binding, Nuclear protein | 3221 | 7189 |
| NM_012342 | NMA | putative transmembrane protein | Transmembrane, Signal, Glycoprotein | 3222 | 7190 |
| NM_012343 | NNT | nicotinamide nucleotide transhydrogenase | Oxidoreductase, NAD, NADP, Transmembrane, Mitochondrion, Transit peptide, 3D-structure, Hypothetical protein | 3223 | 7191 |
| NM_012347 | FBXO9 | F-box only protein 9 | Hypothetical protein, Ubl conjugation pathway, TPR repeat | 3224 | 7192 |
| NM_012383 | OSTF1 | osteoclast stimulating factor 1 | Hypothetical protein, ANK repeat, Repeat, SH3 domain | 3225 | 7193 |
| NM_012384 | GMEB2 | glucocorticoid modulatory element binding protein 2 | Trans-acting factor, Nuclear protein, DNA-binding, Coiled coil | 3226 | 7194 |
| NM_012387 | PADI4 | peptidyl arginine deiminase, type IV | Hydrolase, Calcium-binding, Multigene family | 3227 | 7195 |
| NM_012390 | PROL5 | proline rich 5 (salivary) | Saliva | 3228 | 7196 |
| NM_012392 | PEF | PEF protein with a long N-terminal hydrophobic domain (peflin) | Calcium-binding | 3229 | 7197 |
| NM_012400 | PLA2G2D | phospholipase A2, group IID | Hydrolase, Lipid degradation, Signal, Calcium, Polymorphism | 3230 | 7198 |
| NM_012403 | ANP32C | acidic (leucine-rich) nuclear phosphoprotein 32 family, member C | | 3231 | 7199 |
| NM_012413 | QPCT | glutaminyl-peptide cyclotransferase (glutaminyl cyclase) | Transferase, Acyltransferase, Signal, Polymorphism | 3232 | 7200 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_012434 | SLC17A5 | solute carrier family 17 (anion/sugar transporter), member 5 | Transmembrane, Hypothetical protein, Sugar transport | 3233 | 7201 |
| NM_012445 | SPON2 | spondin 2, extracellular matrix protein | Hypothetical protein, Matrix protein | 3234 | 7202 |
| NM_012446 | SSBP2 | single-stranded DNA binding protein 2 | DNA-binding, Nuclear protein | 3235 | 7203 |
| NM_012455 | TIC | SEC7 homolog | | 3236 | 7204 |
| NM_012460 | TIMM9 | translocase of inner mitochondrial membrane 9 homolog (yeast) | Transport, Protein transport, Translocation, Mitochondrion, Inner membrane, Hypothetical protein | 3237 | 7205 |
| NM_012463 | ATP6V0A2 | ATPase, H+ transporting, lysosomal V0 subunit a isoform 2 | Hydrogen ion transport, Transmembrane, Glycoprotein, Hypothetical protein | 3238 | 7206 |
| NM_012483 | GNLY | granulysin | Antibiotic, Fungicide, Signal, T-cell, Alternative splicing, 3D-structure | 3239 | 7207 |
| NM_012484 | HMMR | hyaluronan-mediated motility receptor (RHAMM) | Hyaluronic acid, Alternative splicing, Repeat, Glycoprotein, Antigen | 3240 | 7208 |
| NM_012485 | HMMR | hyaluronan-mediated motility receptor (RHAMM) | Hyaluronic acid, Alternative splicing, Repeat, Glycoprotein, Antigen | 3241 | 7209 |
| NM_013229 | APAF1 | apoptotic protease activating factor | Apoptosis, ATP-binding, Repeat, WD repeat, Alternative splicing, 3D-structure | 3242 | 7210 |
| NM_013235 | RNASE3L | nuclear RNase III Drosha | Ribosome biogenesis, Hydrolase, Nuclease, Endonuclease, Repeat, RNA-binding, Nuclear protein, Alternative splicing | 3243 | 7211 |
| NM_013236 | E46L | like mouse brain protein E46 | Hypothetical protein | 3244 | 7212 |
| NM_013242 | GTL3 | likely ortholog of mouse gene trap locus 3 | | 3245 | 7213 |
| NM_013248 | NXT1 | NTF2-like export factor 1 | Transport, Protein transport, Nuclear protein, 3D-structure | 3246 | 7214 |
| NM_013252 | CLECSF5 | C-type (calcium dependent, carbohydrate-recognition domain) lectin, superfamily member 5 | Transmembrane, Lectin | 3247 | 7215 |
| NM_013258 | ASC | apoptosis-associated speck-like protein containing a CARD | Apoptosis, Anti-oncogene, Alternative splicing | 3248 | 7216 |
| NM_013259 | NP25 | neuronal protein | | 3249 | 7217 |
| NM_013272 | SLC21A11 | solute carrier organic anion transporter family, member 3A1 | Transmembrane, Transport, Ion transport, Glycoprotein | 3250 | 7218 |
| NM_013285 | HUMAUANTIG | nucleolar GTPase | GTP-binding, Nuclear protein | 3251 | 7219 |
| NM_013286 | KIAA0800 | chromosome 3p21.1 gene sequence | Hypothetical protein | 3252 | 7220 |
| NM_013289 | KIR3DL1 | killer cell immunoglobulin-like receptor, three domains, long cytoplasmic tail, 1 | Receptor, Immunoglobulin domain, Glycoprotein, Signal, Transmembrane, Repeat, Multigene family, Polymorphism, 3D-structure, Alternative splicing | 3253 | 7221 |
| NM_013296 | MCLC | LGN protein | Hypothetical protein, Repeat, TPR repeat, Phosphorylation | 3254 | 7222 |
| NM_013300 | HSU79274 | protein predicted by clone 23733 | Hypothetical protein | 3255 | 7223 |
| NM_013301 | HSU79303 | protein predicted by clone 23882 | Hypothetical protein | 3256 | 7224 |
| NM_013312 | HOOK2 | hook homolog 2 (Drosophila) | Hypothetical protein | 3257 | 7225 |
| NM_013319 | TERE1 | transitional epithelia response protein | | 3258 | 7226 |
| NM_013323 | SNX11 | sorting nexin 11 | Transport, Protein transport | 3259 | 7227 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_013328 | P5CR2 | pyrroline 5-carboxylate reductase isoform | Hypothetical protein | 3260 | 7228 |
| NM_013330 | NME7 | non-metastatic cells 7, protein expressed in (nucleoside-diphosphate kinase) | Transferase, Kinase, ATP-binding, Sodium/potassium transport, Transmembrane, Glycoprotein, Multigene family, Signal-anchor, Alternative splicing | 3261 | 7229 |
| NM_013341 | PTD004 | hypothetical protein PTD004 | GTP-binding, Alternative splicing | 3262 | 7230 |
| NM_013351 | TBX21 | T-box 21 | Transcription regulation, DNA-binding, Nuclear protein, Activator | 3263 | 7231 |
| NM_013354 | CNOT7 | CCR4-NOT transcription complex, subunit 7 | Transcription regulation, Repressor, Nuclear protein, Hypothetical protein | 3264 | 7232 |
| NM_013363 | PCOLCE2 | procollagen C-endopeptidase enhancer 2 | Collagen | 3265 | 7233 |
| NM_013363 | PNMA3 | paraneoplastic antigen MA3 | Hypothetical protein | 3266 | 7234 |
| NM_013368 | RBT1 | RPA-binding trans-activator | Hypothetical protein | 3267 | 7235 |
| NM_013382 | POMT2 | protein-O-mannosyltransferase 2 | Transferase, Glycosyltransferase, Endoplasmic reticulum, Transmembrane, Glycoprotein, Repeat, Alternative splicing | 3268 | 7236 |
| NM_013383 | TCFL4 | transcription factor-like 4 | Transcription regulation, Repressor, Nuclear protein, DNA-binding, Alternative splicing, Receptor | 3269 | 7237 |
| NM_013392 | NRBP | nuclear receptor binding protein | Hypothetical protein, ATP-binding, Transferase, Nuclear protein, Receptor | 3270 | 7238 |
| NM_013395 | AD013 | *Homo sapiens* proteinx0008 (AD013) mRNA, complete cds. | Hypothetical protein, Transmembrane | 3271 | 7239 |
| NM_013403 | STRN4 | striatin, calmodulin binding protein 4 | Calmodulin-binding, Repeat, WD repeat, Coiled coil | 3272 | 7240 |
| NM_013412 | RABL2A | RAB, member of RAS oncogene family-like 2A | Hypothetical protein, GTP-binding, Alternative splicing | 3273 | 7241 |
| NM_013416 | NCF4 | neutrophil cytosolic factor 4, 40 kDa | SH3 domain, Alternative splicing, 3D-structure | 3274 | 7242 |
| NM_013421 | GGT1 | gamma-glutamyltransferase 1 | Glutathione biosynthesis, Transferase, Acyltransferase, Signal-anchor, Transmembrane, Zymogen, Glycoprotein, Sialic acid, Alternative splicing, Alternative promoter usage | 3275 | 7243 |
| NM_013430 | GGT1 | gamma-glutamyltransferase 1 | Glutathione biosynthesis, Transferase, Acyltransferase, Signal-anchor, Transmembrane, Zymogen, Glycoprotein, Sialic acid, Alternative splicing, Alternative promoter usage | 3276 | 7244 |
| NM_013439 | PILR(ALPHA) | paired immunoglobin-like type 2 receptor alpha | Receptor | 3277 | 7245 |
| NM_013440 | PILR(BETA) | paired immunoglobin-like type 2 receptor beta | Meiosis, Cell cycle, Chromosome partition, Nuclear protein, Alternative splicing, Hypothetical protein, Receptor | 3278 | 7246 |
| NM_013444 | UBQLN2 | ubiquilin 2 | Hypothetical protein | 3279 | 7247 |
| NM_013448 | BAZ1A | bromodomain adjacent to zinc finger domain, 1A | Transcription regulation, Bromodomain, Zinc-finger, Coiled coil, Nuclear protein, Alternative splicing | 3280 | 7248 |
| NM_013940 | OR10H1 | olfactory receptor, family 10, subfamily H, member 1 | | 3281 | 7249 |
| NM_013943 | CLIC4 | chloride intracellular channel 4 | Hypothetical protein, Ionic channel, Ion transport, Chloride channel, Voltage-gated channel | 3282 | 7250 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_013951 | PAX8 | paired box gene 8 | DNA-binding, Developmental protein, Nuclear protein, Paired box, Transcription, Transcription regulation, Differentiation, Alternative splicing, Disease mutation, Polymorphism | 3283 | 7251 |
| NM_013956 | NRG1 | neuregulin 1 | EGF-like domain, Growth factor, Transmembrane, Multigene family, Alternative splicing, Immunoglobulin domain, Glycoprotein, Polymorphism, 3D-structure, Chromosomal translocation | 3284 | 7252 |
| NM_013974 | DDAH2 | dimethylarginine dimethylaminohydrolase 2 | Hydrolase | 3285 | 7253 |
| NM_013975 | LIG3 | ligase III, DNA, ATP-dependent | DNA repair, DNA replication, DNA recombination, Cell division, Ligase, ATP-binding, Zinc-finger, Nuclear protein, Alternative splicing, 3D-structure, Hypothetical protein | 3286 | 7254 |
| NM_013979 | BNIP1 | BCL2/adenovirus E1B 19 kDa interacting protein 1 | Apoptosis, Alternative splicing, Transmembrane | 3287 | 7255 |
| NM_013992 | PAX8 | paired box gene 8 | DNA-binding, Developmental protein, Nuclear protein, Paired box, Transcription, Transcription regulation, Differentiation, Alternative splicing, Disease mutation, Polymorphism | 3288 | 7256 |
| NM_013995 | LAMP2 | lysosomal-associated membrane protein 2 | Transmembrane, Glycoprotein, Lysosome, Signal, Alternative splicing, Polymorphism | 3289 | 7257 |
| NM_014000 | VCL | vinculin | Cell adhesion, Actin-binding, Cytoskeleton, Structural protein, Phosphorylation, Repeat, Alternative splicing, Lipoprotein | 3290 | 7258 |
| NM_014011 | SOCS5 | suppressor of cytokine signaling 5 | SH2 domain, Growth regulation, Signal transduction inhibitor | 3291 | 7259 |
| NM_014018 | MRPS28 | mitochondrial ribosomal protein S28 | Ribosomal protein, Mitochondrion | 3292 | 7260 |
| NM_014029 | RAC2 | ras-related C3 botulinum toxin substrate 2 (rho family, small GTP binding protein Rac2) | GTP-binding, Prenylation, Lipoprotein, 3D-structure | 3293 | 7261 |
| NM_014030 | GIT1 | G protein-coupled receptor kinase-interactor 1 | Hypothetical protein, GTPase activation, Repeat, ANK repeat, Zinc-finger | 3294 | 7262 |
| NM_014038 | BZW2 | basic leucine zipper and W2 domains 2 | Hypothetical protein | 3295 | 7263 |
| NM_014042 | DKFZP564M082 | DKFZP564M082 protein | Hypothetical protein | 3296 | 7264 |
| NM_014050 | MRPL42 | mitochondrial ribosomal protein L42 | Ribosomal protein, Mitochondrion | 3297 | 7265 |
| NM_014051 | PTD011 | transmembrane protein 14A | Transmembrane | 3298 | 7266 |
| NM_014052 | GW128 | GW128 protein | | 3299 | 7267 |
| NM_014055 | CDV-1 | carnitine deficiency-associated gene expressed in ventricle 1 | Hypothetical protein | 3300 | 7268 |
| NM_014056 | HIG1 | likely ortholog of mouse hypoxia induced gene 1 | Hypothetical protein | 3301 | 7269 |
| NM_014060 | MCT-1 | malignant T cell amplified sequence 1 | | 3302 | 7270 |
| NM_014061 | MAGEH1 | APR-1 protein | Antigen | 3303 | 7271 |
| NM_014062 | ART-4 | likely ortholog of mouse nin one binding protein | Hypothetical protein | 3304 | 7272 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_014063 | HIP-55 | src homology 3 domain-containing protein HIP-55 | Hypothetical protein, SH3 domain | 3305 | 7273 |
| NM_014078 | MRPL13 | mitochondrial ribosomal protein L13 | Ribosomal protein, Mitochondrion | 3306 | 7274 |
| NM_014080 | DUOX2 | dual oxidase 2 | Peroxidase | 3307 | 7275 |
| NM_014147 | CAPRI | HSPC047 protein | GTPase activation, Repeat | 3308 | 7276 |
| NM_014165 | C6orf66 | chromosome 6 open reading frame 66 | | 3309 | 7277 |
| NM_014170 | HSPC135 | HSPC135 protein | Hypothetical protein | 3310 | 7278 |
| NM_014175 | MRPL15 | mitochondrial ribosomal protein L15 | Hypothetical protein | 3311 | 7279 |
| NM_014177 | HSPC154 | HSPC154 protein | | 3312 | 7280 |
| NM_014180 | MRPL22 | mitochondrial ribosomal protein L22 | Hypothetical protein, Ribosomal protein | 3313 | 7281 |
| NM_014182 | ORMDL2 | ORM1-like 2 (*S. cerevisiae*) | Hypothetical protein, Nuclear protein, DNA-binding, Transcription, Transcription regulation, Translation regulation, Receptor | 3314 | 7282 |
| NM_014184 | HSPC163 | HSPC163 protein | Hypothetical protein, Transmembrane | 3315 | 7283 |
| NM_014204 | BOK | *Homo sapiens* Bcl-2 related ovarian killer (BOK) mRNA, complete cds. | | 3316 | 7284 |
| NM_014207 | CD5 | CD5 antigen (p56-62) | Signal, Transmembrane, Glycoprotein, T-cell, Repeat | 3317 | 7285 |
| NM_014214 | IMPA2 | inositol(myo)-1(or 4)-monophosphatase 2 | Hydrolase | 3318 | 7286 |
| NM_014216 | ITPK1 | inositol 1,3,4-triphosphate 5/6 kinase | Kinase, Hypothetical protein | 3319 | 7287 |
| NM_014221 | MTCP1 | mature T-cell proliferation 1 | Proto-oncogene, Mitochondrion, Alternative splicing, Chromosomal translocation, 3D-structure | 3320 | 7288 |
| NM_014223 | NFYC | nuclear transcription factor Y, gamma | Transcription regulation, DNA-binding, Activator, Nuclear protein, Alternative splicing, 3D-structure | 3321 | 7289 |
| NM_014225 | PPP2R1A | protein phosphatase 2 (formerly 2A), regulatory subunit A (PR 65), alpha isoform | Hypothetical protein, Multigene family, Acetylation, Repeat, Polymorphism, 3D-structure | 3322 | 7290 |
| NM_014231 | VAMP1 | vesicle-associated membrane protein 1 (synaptobrevin 1) | Mitochondrion, Synapse, Synaptosome, Transmembrane, Coiled coil, Alternative splicing, Multigene family | 3323 | 7291 |
| NM_014232 | VAMP2 | vesicle-associated membrane protein 2 (synaptobrevin 2) | Hypothetical protein, Synapse, Synaptosome, Transmembrane, Coiled coil, Acetylation, Multigene family, 3D-structure | 3324 | 7292 |
| NM_014239 | EIF2B2 | eukaryotic translation initiation factor 2B, subunit 2 beta, 39 kDa | Initiation factor, Protein biosynthesis, Disease mutation | 3325 | 7293 |
| NM_014241 | PTPLA | protein tyrosine phosphatase-like (proline instead of catalytic arginine), member a | ATP-binding, Chaperone | 3326 | 7294 |
| NM_014242 | ZNF237 | zinc finger protein 237 | | 3327 | 7295 |
| NM_014245 | RNF7 | ring finger protein 7 | Ubl conjugation pathway, Zinc, Zinc-finger, Metal-binding, Phosphorylation, Alternative splicing | 3328 | 7296 |
| NM_014252 | SLC25A15 | solute carrier family 25 (mitochondrial carrier; ornithine transporter) member 15 | Mitochondrion, Inner membrane, Repeat, Transmembrane, Transport, Disease mutation, Polymorphism | 3329 | 7297 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_014253 | ODZ1 | odz, odd Oz/ten-m homolog 1 (Drosophila) | EGF-like domain | 3330 | 7298 |
| NM_014254 | TMEM5 | transmembrane protein 5 | Transmembrane | 3331 | 7299 |
| NM_014268 | MAPRE2 | microtubule-associated protein, RP/EB family, member 2 | T-cell | 3332 | 7300 |
| NM_014280 | DNAJC8 | DnaJ (Hsp40) homolog, subfamily C, member 8 | Chaperone | 3333 | 7301 |
| NM_014292 | CBX6 | chromobox homolog 6 | Chromatin regulator, Nuclear protein, Transcription regulation, Repressor | 3334 | 7302 |
| NM_014297 | YF13H12 | ethylmalonic encephalopathy 1 | | 3335 | 7303 |
| NM_014306 | HSPC117 | hypothetical protein HSPC117 | Hypothetical protein | 3336 | 7304 |
| NM_014313 | SMP1 | small membrane protein 1 | Transmembrane, Polymorphism | 3337 | 7305 |
| NM_014326 | DAPK2 | death-associated protein kinase 2 | Transferase, Serine/threonine-protein kinase, Calmodulin-binding, Phosphorylation, ATP-binding, Apoptosis | 3338 | 7306 |
| NM_014330 | PPP1R15A | protein phosphatase 1, regulatory (inhibitor) subunit 15A | Hypothetical protein | 3339 | 7307 |
| NM_014335 | CRI1 | CREBBP/EP300 inhibitory protein 1 | Hypothetical protein | 3340 | 7308 |
| NM_014339 | IL17R | interleukin 17 receptor | Receptor, Transmembrane, Signal, Glycoprotein | 3341 | 7309 |
| NM_014341 | MTCH1 | mitochondrial carrier homolog 1 (C. elegans) | | 3342 | 7310 |
| NM_014343 | CLDN15 | claudin 15 | Tight junction, Transmembrane | 3343 | 7311 |
| NM_014350 | GG2-1 | TNF-induced protein | | 3344 | 7312 |
| NM_014357 | XP5 | small proline rich-like (epidermal differentiation complex) 1B | | 3345 | 7313 |
| NM_014359 | OPTC | opticin | Glycoprotein, Extracellular matrix, Signal, Repeat, Leucine-rich repeat, Sulfation | 3346 | 7314 |
| NM_014362 | HIBCH | 3-hydroxyisobutyryl-Coenzyme A hydrolase | Hydrolase | 3347 | 7315 |
| NM_014366 | E2IG3 | nucleostemin | Hypothetical protein | 3348 | 7316 |
| NM_014373 | GPCR1 | G protein-coupled receptor 160 | Receptor | 3349 | 7317 |
| NM_014381 | MLH3 | mutL homolog 3 (E. coli) | DNA repair, Nuclear protein, Polymorphism, Alternative splicing, Hereditary nonpolyposis colorectal cancer, Disease mutation, Hypothetical protein | 3350 | 7318 |
| NM_014399 | NET-6 | transmembrane 4 superfamily member 13 | Glycoprotein, Transmembrane | 3351 | 7319 |
| NM_014403 | SIAT7D | sialyltransferase 7D ((alpha-N-acetylneuraminyl-2,3-beta-galactosyl-1,3)-N-acetyl galactosaminide alpha-2,6-sialyltransferase) | Transferase, Glycosyltransferase, Glycoprotein, Transmembrane, Signal-anchor, Golgi stack | 3352 | 7320 |
| NM_014413 | HRI | heme-regulated initiation factor 2-alpha kinase | Transferase, Kinase, Serine/threonine-protein kinase, Protein synthesis inhibitor, ATP-binding, Repeat, Phosphorylation, Alternative splicing, Polymorphism, Protein biosynthesis | 3353 | 7321 |
| NM_014425 | INVS | inversin | ANK repeat, Repeat | 3354 | 7322 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_014426 | SNX5 | sorting nexin 5 | Transport, Protein transport, Hypothetical protein | 3355 | 7323 |
| NM_014430 | CIDEB | cell death-inducing DFFA-like effector b | Apoptosis, 3D-structure, RNA-binding, Repeat, G-protein coupled receptor, Transmembrane, Glycoprotein | 3356 | 7324 |
| NM_014434 | NR1 | NADPH-dependent FMN and FAD containing oxidoreductase | | 3357 | 7325 |
| NM_014437 | SLC39A1 | solute carrier family 39 (zinc transporter), member 1 | Transport, Zinc transport, Transmembrane | 3358 | 7326 |
| NM_014446 | MIBP | integrin beta 1 binding protein 3 | | 3359 | 7327 |
| NM_014450 | SIT | SHP2-interacting transmembrane adaptor protein | Signal | 3360 | 7328 |
| NM_014453 | BC-2 | putative breast adenocarcinoma marker (32 kD) | | 3361 | 7329 |
| NM_014465 | SULT1B1 | sulfotransferase family, cytosolic, 1B, member 1 | Hypothetical protein, Transferase | 3362 | 7330 |
| NM_014473 | HSA9761 | putative dimethyladenosine transferase | rRNA processing, Transferase, Methyltransferase | 3363 | 7331 |
| NM_014481 | APEX2 | APEX nuclease (apurinic/apyrimidinic endonuclease) 2 | Endonuclease | 3364 | 7332 |
| NM_014499 | P2RY10 | purinergic receptor P2Y, G-protein coupled, 10 | Receptor, Transmembrane | 3365 | 7333 |
| NM_014503 | DRIM | down-regulated in metastasis | | 3366 | 7334 |
| NM_014517 | UBP1 | upstream binding protein 1 (LBP-1a) | Hypothetical protein | 3367 | 7335 |
| NM_014520 | MYBBP1A | MYB binding protein (P160) 1a | Hypothetical protein | 3368 | 7336 |
| NM_014575 | SCHIP1 | schwannomin interacting protein 1 | Hypothetical protein | 3369 | 7337 |
| NM_014593 | CGBP | CpG binding protein | Hypothetical protein, Transcription regulation, Activator, DNA-binding, Zinc-finger, Metal-binding, Coiled coil, Nuclear protein | 3370 | 7338 |
| NM_014624 | S100A6 | S100 calcium binding protein A6 (calcyclin) | Mitogen, Cell cycle, Calcium-binding, Polymorphism, 3D-structure | 3371 | 7339 |
| NM_014630 | KIAA0211 | KIAA0211 gene product | Hypothetical protein, Transcription regulation, DNA-binding, Zinc-finger, Metal-binding, Nuclear protein, Repeat | 3372 | 7340 |
| NM_014638 | KIAA0450 | KIAA0450 gene product | Hypothetical protein | 3373 | 7341 |
| NM_014639 | KIAA0372 | KIAA0372 | Hypothetical protein | 3374 | 7342 |
| NM_014659 | KIAA0377 | KIAA0377 gene product | Hypothetical protein | 3375 | 7343 |
| NM_014671 | KIAA0010 | ubiquitin-protein isopeptide ligase (E3) | Hypothetical protein, Ligase | 3376 | 7344 |
| NM_014675 | KIAA0445 | ciliary rootlet coiled-coil, rootletin | Hypothetical protein | 3377 | 7345 |
| NM_014678 | KIAA0685 | KIAA0685 | Hypothetical protein | 3378 | 7346 |
| NM_014684 | KIAA0373 | KIAA0373 gene product | Hypothetical protein, Coiled coil | 3379 | 7347 |
| NM_014685 | HERPUD1 | homocysteine-inducible, endoplasmic reticulum stress-inducible, ubiquitin-like domain member 1 | Hypothetical protein, Unfolded protein response, Endoplasmic reticulum, Transmembrane, Alternative splicing | 3380 | 7348 |
| NM_014688 | RNTRE | USP6 N-terminal like | Hypothetical protein | 3381 | 7349 |
| NM_014698 | KIAA0792 | KIAA0792 gene product | Hypothetical protein | 3382 | 7350 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_014699 | KIAA0296 | KIAA0296 gene product | Hypothetical protein, Transcription regulation, DNA-binding, Zinc-finger, Metal-binding, Nuclear protein, Repeat | 3383 | 7351 |
| NM_014707 | HDAC9 | histone deacetylase 9 | Hydrolase, Nuclear protein, Chromatin regulator, Transcription regulation, Repressor, Alternative splicing, Hypothetical protein | 3384 | 7352 |
| NM_014710 | KIAA0443 | G protein-coupled receptor-associated sorting protein | Hypothetical protein | 3385 | 7353 |
| NM_014716 | CENTB1 | centaurin, beta 1 | GTPase activation, Repeat, ANK repeat, Zinc-finger | 3386 | 7354 |
| NM_014718 | CLSTN3 | calsyntenin 3 | Cell adhesion, Glycoprotein, Transmembrane, Calcium-binding, Repeat, Signal | 3387 | 7355 |
| NM_014724 | ZNF305 | zinc finger protein 305 | Transcription regulation, DNA-binding, Zinc-finger, Metal-binding, Nuclear protein, Repeat | 3388 | 7356 |
| NM_014727 | WBP7 | myeloid/lymphoid or mixed-lineage leukemia 4 | DNA-binding, Bromodomain, Nuclear protein, Zinc-finger, Metal-binding, Transcription regulation, Alternative splicing, Repeat | 3389 | 7357 |
| NM_014729 | TOX | thymus high mobility group box protein TOX | Hypothetical protein | 3390 | 7358 |
| NM_014732 | KIAA0513 | KIAA0513 gene product | Hypothetical protein | 3391 | 7359 |
| NM_014735 | KIAA0215 | PHD finger protein 16 | Zinc-finger | 3392 | 7360 |
| NM_014737 | RASSF2 | Ras association (RalGDS/AF-6) domain family 2 | Hypothetical protein | 3393 | 7361 |
| NM_014739 | BTF | Bcl-2-associated transcription factor | Hypothetical protein | 3394 | 7362 |
| NM_014740 | KIAA0111 | DEAD (Asp-Glu-Ala-Asp) box polypeptide 48 | ATP-binding, RNA-binding, DNA-binding, Helicase, Nuclear protein, rRNA processing | 3395 | 7363 |
| NM_014750 | DLG7 | discs, large homolog 7 (Drosophila) | Hypothetical protein | 3396 | 7364 |
| NM_014751 | MTSS1 | metastasis suppressor 1 | Cytoskeleton, Actin-binding, Coiled coil, Anti-oncogene, Alternative splicing | 3397 | 7365 |
| NM_014753 | KIAA0187 | BMS1-like, ribosome assembly protein (yeast) | Ribosome biogenesis, Nuclear protein, ATP-binding | 3398 | 7366 |
| NM_014763 | MRPL19 | mitochondrial ribosomal protein L19 | Ribosomal protein, Mitochondrion, Transit peptide | 3399 | 7367 |
| NM_014764 | DAZAP2 | DAZ associated protein 2 | Hypothetical protein | 3400 | 7368 |
| NM_014765 | TOMM20-PENDING | translocase of outer mitochondrial membrane 20 homolog (yeast) | Transport, Protein transport, Outer membrane, Mitochondrion, Transmembrane | 3401 | 7369 |
| NM_014767 | SPOCK2 | sparc/osteonectin, cwcv and kazal-like domains proteoglycan (testican) 2 | Extracellular matrix, Proteoglycan, Heparan sulfate, Glycoprotein, Calcium-binding, Signal | 3402 | 7370 |
| NM_014776 | GIT2 | G protein-coupled receptor kinase-interactor 2 | GTPase activation, Repeat, ANK repeat, Zinc-finger, Alternative splicing, Hypothetical protein | 3403 | 7371 |
| NM_014792 | KIAA0125 | KIAA0125 | Hypothetical protein | 3404 | 7372 |
| NM_014807 | KIAA0285 | KIAA0285 gene product | Hypothetical protein | 3405 | 7373 |
| NM_014808 | FARP2 | FERM, RhoGEF and pleckstrin domain protein 2 | Hypothetical protein | 3406 | 7374 |
| NM_014815 | TRAP100 | thyroid hormone receptor-associated protein (100 kDa) | Transcription regulation, Zinc-finger, Repeat, ATP-binding, Nuclear protein | 3407 | 7375 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_014820 | TOMM70A | translocase of outer mitochondrial membrane 70 homolog A (yeast) | Mitochondrion, Outer membrane, Transmembrane, Repeat, TPR repeat | 3408 | 7376 |
| NM_014830 | KIAA0352 | KIAA0352 gene product | Hypothetical protein, Transcription regulation, DNA-binding, Zinc-finger, Metal-binding, Nuclear protein, Repeat | 3409 | 7377 |
| NM_014835 | OSBPL2 | oxysterol binding protein-like 2 | Lipid transport, Transport, Alternative splicing | 3410 | 7378 |
| NM_014838 | ZBED4 | zinc finger, BED domain containing 4 | Repeat, Zinc-finger | 3411 | 7379 |
| NM_014844 | KIAA0329 | KIAA0329 | Hypothetical protein | 3412 | 7380 |
| NM_014846 | KIAA0196 | KIAA0196 gene product | Hypothetical protein | 3413 | 7381 |
| NM_014861 | KIAA0703 | KIAA0703 gene product | Hydrolase, Calcium transport, Transmembrane, Phosphorylation, ATP-binding, Metal-binding, Magnesium, Calcium-binding, Multigene family | 3414 | 7382 |
| NM_014863 | GALNAC4S-6ST | B cell RAG associated protein | Hypothetical protein, Transferase | 3415 | 7383 |
| NM_014865 | CNAP1 | chromosome condensation-related SMC-associated protein 1 | DNA condensation, Mitosis, Cell cycle, Nuclear protein, Phosphorylation | 3416 | 7384 |
| NM_014869 | KIAA0763 | KIAA0763 gene product | Hypothetical protein | 3417 | 7385 |
| NM_014872 | KIAA0354 | zinc finger and BTB domain containing 5 | Hypothetical protein, Metal-binding, Zinc, Zinc-finger | 3418 | 7386 |
| NM_014873 | KIAA0205 | KIAA0205 gene product | Hypothetical protein, Phospholipid biosynthesis, Transferase, Acyltransferase, Transmembrane | 3419 | 7387 |
| NM_014874 | MFN2 | mitofusin 2 | Hypothetical protein | 3420 | 7388 |
| NM_014878 | KIAA0020 | minor histocompatibility antigen HA-8 | Hypothetical protein, RNA-binding, Repeat, Nuclear protein | 3421 | 7389 |
| NM_014882 | KIAA0053 | KIAA0053 gene product | Hypothetical protein | 3422 | 7390 |
| NM_014886 | YR-29 | TGF beta-inducible nuclear protein 1 | Nuclear protein | 3423 | 7391 |
| NM_014888 | FAM3C | family with sequence similarity 3, member C | Signal | 3424 | 7392 |
| NM_014889 | PITRM1 | pitrilysin metalloproteinase 1 | Metalloprotease, Protease, Hypothetical protein | 3425 | 7393 |
| NM_014897 | KIAA0924 | KIAA0924 protein | Hypothetical protein, Metal-binding, Nuclear protein, Zinc, Zinc-finger | 3426 | 7394 |
| NM_014899 | RHOBTB3 | Rho-related BTB domain containing 3 | Repeat | 3427 | 7395 |
| NM_014902 | KIAA0964 | disks large-associated protein 4 | Membrane, Alternative splicing | 3428 | 7396 |
| NM_014907 | KIAA0967 | KIAA0967 protein | Hypothetical protein | 3429 | 7397 |
| NM_014913 | KIAA0863 | KIAA0863 protein | Hypothetical protein, Metal-binding, Zinc, Zinc-finger | 3430 | 7398 |
| NM_014915 | KIAA1074 | KIAA1074 protein | ANK repeat, Repeat, Hypothetical protein | 3431 | 7399 |
| NM_014929 | KIAA0971 | KIAA0971 protein | Hypothetical protein | 3432 | 7400 |
| NM_014931 | KIAA1115 | KIAA1115 protein | Hypothetical protein | 3433 | 7401 |
| NM_014937 | SAC2 | inositol polyphosphate-5-phosphatase F | Hypothetical protein | 3434 | 7402 |
| NM_014940 | KIAA0872 | HSV-1 stimulation-related gene 1 | Hypothetical protein | 3435 | 7403 |
| NM_014944 | CLSTN1 | calsyntenin 1 | Cell adhesion, Glycoprotein, Transmembrane, Calcium-binding, Repeat, Signal | 3436 | 7404 |
| NM_014947 | KIAA1041 | KIAA1041 protein | Hypothetical protein, Transcription regulation, DNA-binding, Nuclear protein | 3437 | 7405 |
| NM_014949 | KIAA0907 | KIAA0907 protein | Hypothetical protein | 3438 | 7406 |
| NM_014953 | DIS3 | mitotic control protein dis3 homolog | Exosome, Hydrolase, Nuclease, Exonuclease, rRNA processing, Nuclear protein, RNA-binding, Hypothetical protein | 3439 | 7407 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_014965 | KIAA1042 | OGT(O-Glc-NAc transferase)-interacting protein 106 KDa | Glycoprotein, Coiled coil, Hypothetical protein | 3440 | 7408 |
| NM_014966 | DDX30 | DEAH (Asp-Glu-Ala-His) box polypeptide 30 | ATP-binding, Helicase, Hydrolase, Hypothetical protein | 3441 | 7409 |
| NM_014967 | KIAA1018 | KIAA1018 protein | Hypothetical protein | 3442 | 7410 |
| NM_014977 | ACINUS | apoptotic chromatin condensation inducer in the nucleus | Apoptosis, Nuclear protein, Alternative splicing | 3443 | 7411 |
| NM_015057 | KIAA0916 | protein associated with Myc | Hypothetical protein | 3444 | 7412 |
| NM_015156 | RCOR | REST corepressor | DNA-binding, Nuclear protein, Hypothetical protein | 3445 | 7413 |
| NM_015239 | AGTPBP1 | ATP/GTP binding protein 1 | Hypothetical protein | 3446 | 7414 |
| NM_015310 | EFA6R | ADP-ribosylation factor guanine nucleotide factor 6 | Hypothetical protein, Guanine-nucleotide releasing factor | 3447 | 7415 |
| NM_015361 | R3HDM | R3H domain (binds single-stranded nucleic acids) containing | Hypothetical protein | 3448 | 7416 |
| NM_015368 | PANX1 | pannexin 1 | Gap junction, Transmembrane, Polymorphism | 3449 | 7417 |
| NM_015379 | BRI3 | brain protein I3 | Transmembrane | 3450 | 7418 |
| NM_015383 | DJ328E19.C1.1 | hypothetical protein DJ328E19.C1.1 | Hypothetical protein | 3451 | 7419 |
| NM_015392 | NPDC1 | neural proliferation, differentiation and control, 1 | Hypothetical protein, Signal, Transmembrane | 3452 | 7420 |
| NM_015400 | DKFZP586N0721 | DKFZP586N0721 protein | Hypothetical protein | 3453 | 7421 |
| NM_015420 | DKFZP564O0463 | DKFZP564O0463 protein | Repeat, WD repeat, Mitochondrion, Inner membrane, Transmembrane, Transport, Hypothetical protein | 3454 | 7422 |
| NM_015462 | DKFZP586L0724 | DKFZP586L0724 protein | Hypothetical protein | 3455 | 7423 |
| NM_015492 | DKFZP434H132 | DKFZP434H132 protein | Hypothetical protein | 3456 | 7424 |
| NM_015515 | KRT23 | keratin 23 (histone deacetylase inducible) | Hypothetical protein, Intermediate filament, Coiled coil, Keratin | 3457 | 7425 |
| NM_015524 | C6orf4 | chromosome 6 open reading frame 4 | Alternative splicing | 3458 | 7426 |
| NM_015527 | DKFZP434P1750 | DKFZP434P1750 protein | Hypothetical protein | 3459 | 7427 |
| NM_015530 | GORASP2 | golgi reassembly stacking protein 2, 55 kDa | Hypothetical protein | 3460 | 7428 |
| NM_015556 | KIAA0440 | signal-induced proliferation-associated 1 like 1 | Hypothetical protein | 3461 | 7429 |
| NM_015599 | PGM3 | phosphoglucomutase 3 | Hypothetical protein, Isomerase, Phosphorylation, Polymorphism | 3462 | 7430 |
| NM_015610 | DKFZP434J154 | DKFZP434J154 protein | Repeat, WD repeat, Hypothetical protein | 3463 | 7431 |
| NM_015629 | PRPF31 | TCF3 (E2A) fusion partner (in childhood Leukemia) | Hypothetical protein | 3464 | 7432 |
| NM_015640 | PAI-RBP1 | PAI-1 mRNA-binding protein | Hypothetical protein | 3465 | 7433 |
| NM_015644 | ARPC4 | actin related protein 2/3 complex, subunit 4, 20 kDa | Cytoskeleton, Hypothetical protein, Ligase | 3466 | 7434 |
| NM_015654 | DKFZP564C103 | DKFZP564C103 protein | Hypothetical protein | 3467 | 7435 |
| NM_015684 | ATP5S | ATP synthase, H+ transporting, mitochondrial F0 complex, subunit s (factor B) | Hydrogen ion transport, CF(0), Mitochondrion, Transit peptide, Hypothetical protein | 3468 | 7436 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_015696 | CL683 | glutathione peroxidase 6 | Hypothetical protein, Oxidoreductase, Peroxidase, Signal | 3469 | 7437 |
| NM_015699 | DJ159A19.3 | hypothetical protein DJ159A19.3 | Hypothetical protein | 3470 | 7438 |
| NM_015711 | GLTSCR1 | glioma tumor suppressor candidate region gene 1 | | 3471 | 7439 |
| NM_015722 | CALCYON | calcyon protein | Transmembrane, Glycoprotein | 3472 | 7440 |
| NM_015836 | WARS2 | tryptophanyl tRNA synthetase 2 (mitochondrial) | Aminoacyl-tRNA synthetase, Protein biosynthesis, Ligase, ATP-binding, Mitochondrion, Transit peptide | 3473 | 7441 |
| NM_015838 | FCN2 | ficolin (collagen/fibrinogen domain containing lectin) 2 (hucolin) | Lectin, Collagen, Repeat, Glycoprotein, Signal, Multigene family | 3474 | 7442 |
| NM_015839 | FCN2 | ficolin (collagen/fibrinogen domain containing lectin) 2 (hucolin) | Lectin, Collagen, Repeat, Glycoprotein, Signal, Multigene family | 3475 | 7443 |
| NM_015853 | LOC51035 | ORF | Hypothetical protein | 3476 | 7444 |
| NM_015855 | WIT-1 | Wilms tumor associated protein | Polymorphism | 3477 | 7445 |
| NM_015868 | KIR2DL3 | killer cell immunoglobulin-like receptor, two domains, long cytoplasmic tail, 3 | Receptor, Immunoglobulin domain, Glycoprotein, Signal, Transmembrane, Repeat, Multigene family, Polymorphism, 3D-structure, Alternative splicing | 3478 | 7446 |
| NM_015872 | ZFP67 | zinc finger protein 67 homolog (mouse) | Metal-binding, Zinc, Zinc-finger | 3479 | 7447 |
| NM_015905 | TIF1 | transcriptional intermediary factor 1 | Elongation factor, Protein biosynthesis, GTP-binding, Methylation, Multigene family, Transcription regulation, Repressor, DNA-binding, Bromodomain, Zinc-finger, Alternative splicing, Nuclear protein, Coiled coil, Repeat | 3480 | 7448 |
| NM_015907 | LAP3 | leucine aminopeptidase 3 | Hydrolase, Aminopeptidase, Acetylation, Zinc, Magnesium, Manganese | 3481 | 7449 |
| NM_015908 | ARS2 | arsenate resistance protein ARS2 | Hypothetical protein, Alternative splicing | 3482 | 7450 |
| NM_015932 | C13orf12 | chromosome 13 open reading frame 12 | Hypothetical protein | 3483 | 7451 |
| NM_015942 | LOC51001 | CGI-12 protein | Hypothetical protein | 3484 | 7452 |
| NM_015945 | OVCOV1 | solute carrier family 35, member C2 | Hypothetical protein | 3485 | 7453 |
| NM_015956 | MRPL4 | mitochondrial ribosomal protein L4 | Ribosomal protein | 3486 | 7454 |
| NM_015958 | LOC51611 | CGI-30 protein | Transferase, Methyltransferase, Alternative splicing, Hypothetical protein | 3487 | 7455 |
| NM_015959 | LOC51075 | thioredoxin-related transmembrane protein 2 | Hypothetical protein | 3488 | 7456 |
| NM_015963 | LOC51078 | THAP domain containing 4 | Zinc-finger, DNA-binding | 3489 | 7457 |
| NM_015967 | PTPN22 | protein tyrosine phosphatase, non-receptor type 22 (lymphoid) | Hydrolase, Alternative splicing, Hypothetical protein | 3490 | 7458 |
| NM_015971 | MRPS7 | mitochondrial ribosomal protein S7 | Ribosomal protein | 3491 | 7459 |
| NM_015984 | UCHL5 | ubiquitin carboxyl-terminal hydrolase L5 | Hypothetical protein, Ubl conjugation pathway, Hydrolase, Thiol protease, Proteasome, Alternative splicing, Polymorphism | 3492 | 7460 |
| NM_015999 | LOC51094 | adiponectin receptor 1 | Fatty acid metabolism, Lipid metabolism, Receptor, Transmembrane | 3493 | 7461 |
| NM_016006 | CGI-58 | abhydrolase domain containing 5 | Hypothetical protein | 3494 | 7462 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_016017 | UCHL5 | ubiquitin carboxyl-terminal hydrolase L5 | Hypothetical protein, Hydrolase, Ubl conjugation pathway, Thiol protease, Proteasome, Alternative splicing, Polymorphism | 3495 | 7463 |
| NM_016022 | LOC51107 | likely ortholog of C. elegans anterior pharynx defective 1A | Transmembrane, Golgi stack, Endoplasmic reticulum, Alternative splicing | 3496 | 7464 |
| NM_016026 | RDH11 | retinol dehydrogenase 11 (all-trans and 9-cis) | Oxidoreductase, NADP, Signal-anchor, Transmembrane, Endoplasmic reticulum, Alternative splicing | 3497 | 7465 |
| NM_016039 | LOC51637 | chromosome 14 open reading frame 166 | Hypothetical protein | 3498 | 7466 |
| NM_016045 | C20orf45 | chromosome 20 open reading frame 45 | | 3499 | 7467 |
| NM_016052 | LOC51018 | CGI-115 protein | | 3500 | 7468 |
| NM_016055 | MRPL48 | mitochondrial ribosomal protein L48 | Ribosomal protein, Mitochondrion | 3501 | 7469 |
| NM_016056 | LOC51643 | CGI-119 protein | Transmembrane, Polymorphism | 3502 | 7470 |
| NM_016058 | LOC51002 | CGI-121 protein | | 3503 | 7471 |
| NM_016064 | PILB | methionine sulfoxide reductase B | Hypothetical protein | 3504 | 7472 |
| NM_016072 | LOC51026 | CGI-141 protein | Hypothetical protein, Transmembrane | 3505 | 7473 |
| NM_016075 | C13orf9 | chromosome 13 open reading frame 9 | Hypothetical protein | 3506 | 7474 |
| NM_016082 | CDK5RAP1 | CDK5 regulatory subunit associated protein 1 | Alternative splicing | 3507 | 7475 |
| NM_016093 | RPL26L1 | ribosomal protein L26-like 1 | Ribosomal protein | 3508 | 7476 |
| NM_016096 | LOC51123 | HSPC038 protein | Metal-binding, Zinc, Zinc-finger | 3509 | 7477 |
| NM_016101 | HSPC031 | comparative gene identification transcript 37 | Hypothetical protein | 3510 | 7478 |
| NM_016120 | RNF12 | ring finger protein 12 | Hypothetical protein, Metal-binding, Zinc, Zinc-finger, Transcription regulation | 3511 | 7479 |
| NM_016122 | LOC51134 | NY-REN-58 antigen | | 3512 | 7480 |
| NM_016126 | LOC51668 | HSPCO34 protein | | 3513 | 7481 |
| NM_016127 | MGC8721 | hypothetical protein MGC8721 | Hypothetical protein | 3514 | 7482 |
| NM_016129 | COPS4 | COP9 constitutive photomorphogenic homolog subunit 4 (Arabidopsis) | Hypothetical protein | 3515 | 7483 |
| NM_016143 | NSFL1C | NSFL1 (p97) cofactor (p47) | Hypothetical protein | 3516 | 7484 |
| NM_016167 | RANBP9 | retinoic acid repressible protein | Hypothetical protein | 3517 | 7485 |
| NM_016175 | SQSTM1 | truncated calcium binding protein | Hypothetical protein | 3518 | 7486 |
| NM_016183 | C1orf33 | chromosome 1 open reading frame 33 | Hypothetical protein, Ribosomal protein | 3519 | 7487 |
| NM_016184 | CLECSF6 | C-type (calcium dependent, carbohydrate-recognition domain) lectin, superfamily member 6 | Receptor, Lectin | 3520 | 7488 |
| NM_016187 | BIN2 | bridging integrator 2 | Hypothetical protein | 3521 | 7489 |
| NM_016194 | GNB5 | guanine nucleotide binding protein (G protein), beta 5 | Repeat, WD repeat, Transducer, Alternative splicing, Multigene family, Hypothetical protein | 3522 | 7490 |
| NM_016199 | LSM7 | LSM7 homolog, U6 small nuclear RNA associated (S. cerevisiae) | Nuclear protein, Ribonucleoprotein, mRNA splicing, mRNA processing, RNA-binding | 3523 | 7491 |
| NM_016202 | LOC51157 | LDL induced EC protein | Metal-binding, Zinc, Zinc-finger | 3524 | 7492 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_016207 | CPSF3 | cleavage and polyadenylation specific factor 3, 73 kDa | mRNA processing, Nuclear protein, RNA-binding | 3525 | 7493 |
| NM_016208 | VPS28 | vacuolar protein sorting 28 (yeast) | Transport, Protein transport | 3526 | 7494 |
| NM_016214 | COL18A1 | collagen, type XVIII, alpha 1 | Collagen, Extracellular matrix, Connective tissue, Repeat, Hydroxylation, Cell adhesion, Glycoprotein, Signal, Alternative splicing, Polymorphism, 3D-structure | 3527 | 7495 |
| NM_016221 | DCTN4 | dynactin 4 (p62) | Hypothetical protein | 3528 | 7496 |
| NM_016229 | LOC51700 | cytochrome b5 reductase b5R.2 | Hypothetical protein | 3529 | 7497 |
| NM_016237 | ANAPC5 | anaphase promoting complex subunit 5 | Ubl conjugation pathway, Cell cycle, Cell division, Mitosis, Repeat, TPR repeat, Alternative splicing | 3530 | 7498 |
| NM_016258 | HGRG8 | high-glucose-regulated protein 8 | | 3531 | 7499 |
| NM_016271 | RNF138 | ring finger protein 138 | Hypothetical protein, Metal-binding, Zinc, Zinc-finger | 3532 | 7500 |
| NM_016274 | CKIP-1 | CK2 interacting protein 1; HQ0024c protein | Hypothetical protein | 3533 | 7501 |
| NM_016283 | TAF9 | TAF9 RNA polymerase II, TATA box binding protein (TBP)-associated factor, 32 kDa | ATP-binding, Transcription regulation, Nuclear protein, Polymorphism, Hypothetical protein, Cell cycle | 3534 | 7502 |
| NM_016293 | BIN2 | bridging integrator 2 | Hypothetical protein | 3535 | 7503 |
| NM_016299 | HSP70-4 | likely ortholog of mouse heat shock protein, 70 kDa 4 | ATP-binding | 3536 | 7504 |
| NM_016304 | C15orf15 | chromosome 15 open reading frame 15 | Ribosomal protein | 3537 | 7505 |
| NM_016306 | DNAJB11 | DnaJ (Hsp40) homolog, subfamily B, member 11 | Chaperone, Endoplasmic reticulum, Signal, Polymorphism | 3538 | 7506 |
| NM_016309 | LCMT1 | leucine carboxyl methyltransferase 1 | Hypothetical protein, Methyltransferase, Transferase | 3539 | 7507 |
| NM_016312 | WBP11 | WW domain binding protein 11 | Hypothetical protein | 3540 | 7508 |
| NM_016316 | REV1L | REV1-like (yeast) | Transferase, Integrin, Hypothetical protein | 3541 | 7509 |
| NM_016326 | CKLF | chemokine-like factor | Chemotaxis, Cytokine, Transmembrane, Alternative splicing | 3542 | 7510 |
| NM_016327 | UPB1 | ureidopropionase, beta | Hydrolase, Allosteric enzyme, Zinc | 3543 | 7511 |
| NM_016331 | LOC51193 | zinc finger protein ANC_2H01 | Metal-binding, Zinc, Zinc-finger | 3544 | 7512 |
| NM_016332 | SEPX1 | selenoprotein X, 1 | Oxidoreductase, Metal-binding, Zinc, Selenium, Selenocysteine | 3545 | 7513 |
| NM_016333 | SRRM2 | serine/arginine repetitive matrix 2 | Hypothetical protein | 3546 | 7514 |
| NM_016334 | SH120 | putative G-protein coupled receptor | Receptor | 3547 | 7515 |
| NM_016354 | SLC21A12 | solute carrier organic anion transporter family, member 4A1 | Transmembrane, Transport, Ion transport, Glycoprotein, Alternative splicing | 3548 | 7516 |
| NM_016355 | LOC51202 | DEAD (Asp-Glu-Ala-Asp) box polypeptide 47 | ATP-binding, Helicase, Hydrolase, Hypothetical protein | 3549 | 7517 |
| NM_016362 | GHRL | ghrelin precursor | Hormone, Cleavage on pair of basic residues, Signal, Lipoprotein, Alternative splicing | 3550 | 7518 |
| NM_016364 | DUSP13 | dual specificity phosphatase 13 | Hydrolase | 3551 | 7519 |
| NM_016373 | WWOX | WW domain containing oxidoreductase | Oxidoreductase | 3552 | 7520 |
| NM_016377 | AKAP7 | A kinase (PRKA) anchor protein 7 | Membrane, Myristate, Palmitate, Lipoprotein, Alternative splicing | 3553 | 7521 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_016381 | TREX1 | three prime repair exonuclease 1 | Exonuclease, Hypothetical protein | 3554 | 7522 |
| NM_016385 | CYLD | cylindromatosis (turban tumor syndrome) | Hypothetical protein | 3555 | 7523 |
| NM_016387 | HSPC060 | hypothetical protein HSPC060 | | 3556 | 7524 |
| NM_016391 | HSPC111 | hypothetical protein HSPC111 | Hypothetical protein, Nuclear protein | 3557 | 7525 |
| NM_016397 | TH1L | TH1-like (*Drosophila*) | Transcription regulation, Repressor, Nuclear protein, Alternative splicing, Alternative initiation | 3558 | 7526 |
| NM_016399 | HSPC132 | hypothetical protein HSPC132 | Hypothetical protein | 3559 | 7527 |
| NM_016403 | HSPC148 | hypothetical protein HSPC148 | Hypothetical protein | 3560 | 7528 |
| NM_016407 | C20orf43 | chromosome 20 open reading frame 43 | Alternative splicing | 3561 | 7529 |
| NM_016418 | NF2 | neurofibromin 2 (bilateral acoustic neuroma) | Structural protein, Cytoskeleton, Anti-oncogene, Disease mutation, Alternative splicing, Deafness, 3D-structure | 3562 | 7530 |
| NM_016424 | LUC7A | cisplatin resistance-associated overexpressed protein | Phosphorylation, Hypothetical protein | 3563 | 7531 |
| NM_016431 | MAPK8IP2 | mitogen-activated protein kinase 8 interacting protein 2 | SH3 domain, Alternative splicing | 3564 | 7532 |
| NM_016441 | CRIM1 | cysteine-rich motor neuron 1 | Signal | 3565 | 7533 |
| NM_016463 | HSPC195 | hypothetical protein HSPC195 | Hypothetical protein | 3566 | 7534 |
| NM_016465 | LOC51238 | blocked early in transport 1 homolog (*S. cerevisiae*) like | Hypothetical protein | 3567 | 7535 |
| NM_016468 | C14orf112 | chromosome 14 open reading frame 112 | Hypothetical protein | 3568 | 7536 |
| NM_016477 | FOXP1 | forkhead box P1 | Hypothetical protein, Transcription regulation, DNA-binding, Zinc-finger, Metal-binding, Nuclear protein, Alternative splicing | 3569 | 7537 |
| NM_016479 | SCOTIN | scotin | Hypothetical protein | 3570 | 7538 |
| NM_016501 | FLJ10597 | hypothetical protein FLJ10597 | Hypothetical protein | 3571 | 7539 |
| NM_016503 | MRPL30 | mitochondrial ribosomal protein L30 | Hypothetical protein | 3572 | 7540 |
| NM_016507 | CRK7 | CDC2-related protein kinase 7 | Transferase, Serine/threonine-protein kinase, ATP-binding, Nuclear protein | 3573 | 7541 |
| NM_016524 | LOC51760 | B/K protein | Hypothetical protein | 3574 | 7542 |
| NM_016533 | NINJ2 | ninjurin 2 | Cell adhesion, Transmembrane | 3575 | 7543 |
| NM_016538 | SIRT7 | sirtuin (silent mating type information regulation 2 homolog) 7 (*S. cerevisiae*) | Hydrolase, NAD, Metal-binding, Zinc, Alternative splicing | 3576 | 7544 |
| NM_016565 | E2IG2 | E2IG2 protein | | 3577 | 7545 |
| NM_016567 | BCCIP | BRCA2 and CDKN1A interacting protein | Helicase, Hypothetical protein | 3578 | 7546 |
| NM_016572 | USP21 | ubiquitin specific protease 21 | Hypothetical protein, Ubl conjugation pathway, Hydrolase, Thiol protease, Multigene family | 3579 | 7547 |
| NM_016573 | LOC51291 | Gem-interacting protein | | 3580 | 7548 |
| NM_016574 | DRD2 | dopamine receptor D2 | G-protein coupled receptor, Transmembrane, Glycoprotein, Multigene family, Alternative splicing, Disease mutation, Polymorphism, 3D-structure | 3581 | 7549 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_016582 | FLJ20539 | solute carrier family 15, member 3 | Hypothetical protein | 3582 | 7550 |
| NM_016594 | FKBP11 | FK506 binding protein 11, 19 kDa | Isomerase, Rotamase, Signal | 3583 | 7551 |
| NM_016598 | ZDHHC3 | zinc finger, DHHC domain containing 3 | Transmembrane, Golgi stack, Zinc-finger, Alternative splicing | 3584 | 7552 |
| NM_016603 | C5orf5 | chromosome 5 open reading frame 5 | GTPase activation | 3585 | 7553 |
| NM_016608 | ALEX1 | ALEX1 protein | Hypothetical protein | 3586 | 7554 |
| NM_016610 | TLR8 | toll-like receptor 8 | Hypothetical protein, Receptor, Immune response, Inflammatory response, Signal, Transmembrane, Repeat, Leucine-rich repeat, Glycoprotein | 3587 | 7555 |
| NM_016612 | MSCP | mitochondrial solute carrier protein | Hypothetical protein | 3588 | 7556 |
| NM_016616 | TXNDC3 | thioredoxin domain containing 3 (spermatozoa) | Redox-active center | 3589 | 7557 |
| NM_016619 | PLAC8 | placenta-specific 8 | | 3590 | 7558 |
| NM_016623 | BM-009 | hypothetical protein BM-009 | Hypothetical protein | 3591 | 7559 |
| NM_016626 | LOC51320 | hypothetical protein LOC51320 | Metal-binding, Zinc, Zinc-finger | 3592 | 7560 |
| NM_016630 | ACP33 | acid cluster protein 33 | Hypothetical protein | 3593 | 7561 |
| NM_016639 | TNFRSF12A | tumor necrosis factor receptor superfamily, member 12A | Receptor, Angiogenesis, Apoptosis, Transmembrane, Signal, Alternative splicing | 3594 | 7562 |
| NM_016640 | MRPS30 | mitochondrial ribosomal protein S30 | Ribosomal protein, Mitochondrion | 3595 | 7563 |
| NM_016733 | LIMK2 | LIM domain kinase 2 | Transferase, Serine/threonine-protein kinase, ATP-binding, Repeat, LIM domain, Metal-binding, Zinc, Kinase, Tyrosine-protein kinase, Hypothetical protein | 3596 | 7564 |
| NM_016826 | OGG1 | 8-oxoguanine DNA glycosylase | Hydrolase, Nuclease, Endonuclease, Lyase, DNA repair, Glycosidase, Multifunctional enzyme, Nuclear protein, Mitochondrion, Alternative splicing, Polymorphism, 3D-structure, Transferase, Serine/threonine-protein kinase, Calmodulin-binding, Phosphorylation, | 3597 | 7565 |
| NM_016827 | OGG1 | 8-oxoguanine DNA glycosylase | Hydrolase, Nuclease, Endonuclease, Lyase, DNA repair, Glycosidase, Multifunctional enzyme, Nuclear protein, Mitochondrion, Alternative splicing, Polymorphism, 3D-structure, Transferase, Serine/threonine-protein kinase, Calmodulin-binding, Phosphorylation, | 3598 | 7566 |
| NM_016836 | RBMS1 | RNA binding motif, single stranded interacting protein 1 | DNA-binding, DNA replication, RNA-binding, Nuclear protein, Phosphorylation | 3599 | 7567 |
| NM_016839 | RBMS1 | RNA binding motif, single stranded interacting protein 1 | DNA-binding, DNA replication, RNA-binding, Nuclear protein, Phosphorylation | 3600 | 7568 |
| NM_016936 | UBN1 | ubinuclein 1 | | 3601 | 7569 |
| NM_016951 | CKLF | chemokine-like factor | Chemotaxis, Cytokine, Transmembrane, Alternative splicing | 3602 | 7570 |
| NM_017409 | HOXC10 | homeo box C10 | Homeobox, DNA-binding, Developmental protein, Nuclear protein, Transcription regulation | 3603 | 7571 |
| NM_017414 | USP18 | ubiquitin specific protease 18 | Ubl conjugation pathway, Hydrolase, Thiol protease, Multigene family | 3604 | 7572 |
| NM_017415 | KLHL3 | kelch-like 3 (*Drosophila*) | Cytoskeleton, Actin-binding, Kelch repeat, Repeat, Alternative splicing | 3605 | 7573 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_017421 | COQ3 | coenzyme Q3 homolog, methyltransferase (yeast) | Transferase | 3606 | 7574 |
| NM_017424 | CECR1 | cat eye syndrome chromosome region, candidate 1 | Hydrolase, Signal, Hypothetical protein | 3607 | 7575 |
| NM_017426 | NUP54 | nucleoporin 54 kDa | Hypothetical protein, Transport, Nuclear protein, Repeat, Glycoprotein, Alternative splicing | 3608 | 7576 |
| NM_017451 | BAIAP2 | BAI1-associated protein 2 | Receptor, SH3 domain, Hypothetical protein, ATP-binding, Transferase | 3609 | 7577 |
| NM_017455 | SDFR1 | stromal cell derived factor receptor 1 | Immunoglobulin domain, Hypothetical protein, Receptor | 3610 | 7578 |
| NM_017456 | PSCD1 | pleckstrin homology, Sec7 and coiled-coil domains 1(cytohesin 1) | Guanine-nucleotide releasing factor, Coiled coil, Alternative splicing, 3D-structure | 3611 | 7579 |
| NM_017491 | WDR1 | WD repeat domain 1 | Repeat, WD repeat, Hypothetical protein, Actin-binding, Cytoskeleton, Alternative splicing, Polymorphism | 3612 | 7580 |
| NM_017493 | HSHIN1 | HIV-1 induced protein HIN-1 | | 3613 | 7581 |
| NM_017535 | DKFZp566H0824 | hypothetical protein DKFZp566H0824 | Hypothetical protein | 3614 | 7582 |
| NM_017544 | NRF | NF-kappa B-repressing factor | Transcription regulation, Repressor, DNA-binding, Nuclear protein | 3615 | 7583 |
| NM_017546 | C40 | hypothetical protein C40 | Hypothetical protein | 3616 | 7584 |
| NM_017555 | EGLN2 | egl nine homolog 2 (C. elegans) | Oxidoreductase, Dioxygenase, Nuclear protein, Iron, Vitamin C | 3617 | 7585 |
| NM_017567 | NAGK | N-acetylglucosamine kinase | Kinase, Transferase, ATP-binding, Phosphorylation, Hypothetical protein | 3618 | 7586 |
| NM_017571 | LOC55580 | hypothetical protein LOC55580 | Hypothetical protein | 3619 | 7587 |
| NM_017572 | MKNK2 | MAP kinase-interacting serine/threonine kinase 2 | Hypothetical protein, ATP-binding, Kinase, Serine/threonine-protein kinase, Transferase, Translation regulation, Phosphorylation, Alternative splicing | 3620 | 7588 |
| NM_017596 | KIAA0449 | KIAA0449 protein | Hypothetical protein, Repeat, WD repeat | 3621 | 7589 |
| NM_017622 | FLJ20014 | hypothetical protein FLJ20014 | Hypothetical protein | 3622 | 7590 |
| NM_017631 | FLJ20035 | hypothetical protein FLJ20035 | Hypothetical protein | 3623 | 7591 |
| NM_017633 | C6orf37 | chromosome 6 open reading frame 37 | Hypothetical protein | 3624 | 7592 |
| NM_017646 | IPT | tRNA isopentenyltransferase 1 | Hypothetical protein, Transferase | 3625 | 7593 |
| NM_017664 | ANKRD10 | ankyrin repeat domain 10 | Hypothetical protein, ANK repeat, Repeat | 3626 | 7594 |
| NM_017681 | FLJ20130 | hypothetical protein FLJ20130 | Hypothetical protein, Porin | 3627 | 7595 |
| NM_017694 | FLJ20160 | FLJ20160 protein | Hypothetical protein | 3628 | 7596 |
| NM_017700 | FLJ20184 | hypothetical protein FLJ20184 | Hypothetical protein | 3629 | 7597 |
| NM_017703 | FBXL12 | F-box and leucine-rich repeat protein 12 | Ubl conjugation pathway, Repeat, Leucine-rich repeat, Alternative splicing | 3630 | 7598 |
| NM_017714 | C20orf13 | chromosome 20 open reading frame 13 | Hydrolase | 3631 | 7599 |
| NM_017730 | FLJ20259 | FLJ20259 protein | Hypothetical protein | 3632 | 7600 |
| NM_017735 | FLJ20272 | hypothetical protein FLJ20272 | Hypothetical protein | 3633 | 7601 |
| NM_017737 | FLJ20275 | transducer of Cdc42-dependent actin assembly 1 | Hypothetical protein, SH3 domain | 3634 | 7602 |
| NM_017740 | ZDHHC7 | zinc finger, DHHC domain containing 7 | Transmembrane, Zinc-finger, Alternative splicing | 3635 | 7603 |
| NM_017742 | FLJ20281 | zinc finger, CCHC domain containing 2 | Hypothetical protein, Zinc-finger | 3636 | 7604 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_017746 | FLJ20287 | hypothetical protein-FLJ20287 | Hypothetical protein | 3637 | 7605 |
| NM_017756 | FLJ20306 | hypothetical protein FLJ20306 | Hypothetical protein | 3638 | 7606 |
| NM_017775 | FLJ20343 | hypothetical protein FLJ20343 | Hypothetical protein | 3639 | 7607 |
| NM_017785 | FLJ20364 | hypothetical protein FLJ20364 | Hypothetical protein | 3640 | 7608 |
| NM_017787 | FLJ20154 | chromosome 10 open reading frame 26 | Hypothetical protein | 3641 | 7609 |
| NM_017801 | CKLFSF6 | chemokine-like factor super family 6 | Chemotaxis, Cytokine, Transmembrane | 3642 | 7610 |
| NM_017803 | FLJ20399 | hypothetical protein FLJ20399 | Hypothetical protein | 3643 | 7611 |
| NM_017812 | FLJ20420 | hypothetical protein FLJ20420 | Hypothetical protein | 3644 | 7612 |
| NM_017814 | FLJ20422 | hypothetical protein FLJ20422 | Hypothetical protein | 3645 | 7613 |
| NM_017816 | LYAR | hypothetical protein FLJ20425 | Hypothetical protein | 3646 | 7614 |
| NM_017817 | RAB20 | RAB20, member RAS oncogene family | GTP-binding, Lipoprotein, Prenylation, Protein transport, Polymorphism | 3647 | 7615 |
| NM_017819 | FLJ20432 | hypothetical protein FLJ20432 | Hypothetical protein | 3648 | 7616 |
| NM_017820 | FLJ20433 | hypothetical protein FLJ20433 | Hypothetical protein | 3649 | 7617 |
| NM_017821 | RHBDL2 | rhomboid, veinlet-like 2 (*Drosophila*) | Hydrolase, Protease, Serine protease, Transmembrane | 3650 | 7618 |
| NM_017824 | FLJ20445 | hypothetical protein FLJ20445 | Hypothetical protein | 3651 | 7619 |
| NM_017836 | FLJ20473 | hypothetical protein FLJ20473 | Hypothetical protein | 3652 | 7620 |
| NM_017838 | NOLA2 | nucleolar protein family A, member 2 (H/ACA small nucleolar RNPs) | | 3653 | 7621 |
| NM_017840 | MRPL16 | mitochondrial ribosomal protein L16 | Ribosomal protein, Hypothetical protein | 3654 | 7622 |
| NM_017844 | ANKMY1 | ankyrin repeat and MYND domain containing 1 | Hypothetical protein, ANK repeat, Repeat, Zinc-finger, Alternative splicing | 3655 | 7623 |
| NM_017847 | C1orf27 | chromosome 1 open reading frame 27 | Hypothetical protein | 3656 | 7624 |
| NM_017849 | FLJ20507 | hypothetical protein FLJ20507 | Hypothetical protein | 3657 | 7625 |
| NM_017850 | FLJ20508 | hypothetical protein FLJ20508 | Hypothetical protein | 3658 | 7626 |
| NM_017859 | URKL1 | uridine kinase-like 1 | Transferase, Kinase, ATP-binding | 3659 | 7627 |
| NM_017866 | FLJ20533 | hypothetical protein FLJ20533 | Hypothetical protein | 3660 | 7628 |
| NM_017874 | C20orf27 | chromosome 20 open reading frame 27 | Hypothetical protein | 3661 | 7629 |
| NM_017885 | FLJ20568 | host cell factor C1 regulator 1 (XPO1 dependant) | Hypothetical protein | 3662 | 7630 |
| NM_017895 | DDX27 | DEAD (Asp-Glu-Ala-Asp) box polypeptide 27 | Hydrolase, Helicase, ATP-binding, Nuclear protein, Alternative splicing | 3663 | 7631 |
| NM_017899 | TSC | hypothetical protein FLJ20607 | Calcium-binding, Hypothetical protein | 3664 | 7632 |
| NM_017900 | FLJ20608 | aurora-A kinase interacting protein | Hypothetical protein, Nuclear protein | 3665 | 7633 |
| NM_017906 | FLJ20624 | PAK1 interacting protein 1 | Hypothetical protein, Repeat, WD repeat | 3666 | 7634 |
| NM_017907 | FLJ20625 | hypothetical protein FLJ20625 | Hypothetical protein | 3667 | 7635 |
| NM_017910 | FLJ20628 | hypothetical protein FLJ20628 | Hypothetical protein | 3668 | 7636 |
| NM_017942 | BTBD1 | BTB (POZ) domain containing 1 | | 3669 | 7637 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_017952 | FLJ20758 | FLJ20758 protein | Hypothetical protein | 3670 | 7638 |
| NM_017953 | FLJ20729 | hypothetical protein FLJ20729 | Hypothetical protein | 3671 | 7639 |
| NM_017956 | FLJ20772 | hypothetical protein FLJ20772 | Hypothetical protein | 3672 | 7640 |
| NM_017983 | KIAA1001 | hypothetical protein FLJ10055 | Hypothetical protein, Repeat, WD repeat | 3673 | 7641 |
| NM_018007 | FBXO4 | *Homo sapiens* cDNA FLJ10141 fis, clone HEMBA1003199. | Ubl conjugation pathway, Hypothetical protein | 3674 | 7642 |
| NM_018024 | FLJ10204 | hypothetical protein FLJ10204 | Hypothetical protein | 3675 | 7643 |
| NM_018044 | WBSCR20A | Williams Beuren syndrome chromosome region 20A | Nuclear protein, Transport, Transmembrane, Repeat, Hypothetical protein | 3676 | 7644 |
| NM_018045 | FLJ10276 | hypothetical protein FLJ10276 | Hypothetical protein | 3677 | 7645 |
| NM_018050 | FLJ10298 | hypothetical protein FLJ10298 | Hypothetical protein | 3678 | 7646 |
| NM_018051 | FLJ10300 | hypothetical protein FLJ10300 | Hypothetical protein, Repeat, WD repeat | 3679 | 7647 |
| NM_018053 | FLJ10307 | hypothetical protein FLJ10307 | Hypothetical protein | 3680 | 7648 |
| NM_018056 | FLJ10315 | hypothetical protein FLJ10315 | Hypothetical protein | 3681 | 7649 |
| NM_018059 | FLJ10324 | hypothetical protein FLJ10324 | Hypothetical protein | 3682 | 7650 |
| NM_018067 | FLJ10350 | hypothetical protein FLJ10350 | Hypothetical protein | 3683 | 7651 |
| NM_018075 | FLJ10375 | hypothetical protein FLJ10375 | Hypothetical protein | 3684 | 7652 |
| NM_018087 | FLJ10407 | hypothetical protein FLJ10407 | Hypothetical protein | 3685 | 7653 |
| NM_018089 | FLJ10415 | hypothetical protein FLJ10415 | Hypothetical protein, ANK repeat, Repeat | 3686 | 7654 |
| NM_018093 | FLJ10439 | hypothetical protein FLJ10439 | Hypothetical protein, Repeat, WD repeat | 3687 | 7655 |
| NM_018099 | FLJ10462 | hypothetical protein FLJ10462 | Hypothetical protein | 3688 | 7656 |
| NM_018100 | FLJ10466 | EF-hand domain (C-terminal) containing 1 | Hypothetical protein | 3689 | 7657 |
| NM_018113 | LIMR | lipocalin-interacting membrane receptor | Hypothetical protein, Receptor | 3690 | 7658 |
| NM_018119 | SIN | RNA polymerase III 80 kDa subunit RPC5 | Transferase, DNA-directed RNA polymerase, Transcription, Nuclear protein, Alternative splicing | 3691 | 7659 |
| NM_018125 | FLJ10521 | hypothetical protein FLJ10521 | Hypothetical protein | 3692 | 7660 |
| NM_018127 | ELAC2 | elaC homolog 2 (*E. coli*) | Hypothetical protein | 3693 | 7661 |
| NM_018128 | SRR | hypothetical protein FLJ10534 | Isomerase, Pyridoxal phosphate, Hypothetical protein | 3694 | 7662 |
| NM_018137 | PRMT6 | protein arginine N-methyltransferase 6 | Transferase, Methyltransferase, Nuclear protein, Methylation | 3695 | 7663 |
| NM_018140 | FLJ10565 | hypothetical protein FLJ10565 | Hypothetical protein | 3696 | 7664 |
| NM_018142 | FLJ10569 | hypothetical protein FLJ10569 | Hypothetical protein | 3697 | 7665 |
| NM_018147 | FAIM | Fas apoptotic inhibitory molecule | Apoptosis, Alternative splicing | 3698 | 7666 |
| NM_018158 | SLC4A1AP | solute carrier family 4 (anion exchanger), member 1, adaptor protein | Hypothetical protein, Transcription regulation, Nuclear protein, Antigen, Alternative splicing | 3699 | 7667 |
| NM_018161 | FLJ10631 | NAD synthetase 1 | Hypothetical protein | 3700 | 7668 |
| NM_018169 | FLJ10652 | hypothetical protein FLJ10652 | Hypothetical protein | 3701 | 7669 |
| NM_018170 | FLJ10656 | hypothetical protein FLJ10656 | Kinase, Hypothetical protein | 3702 | 7670 |
| NM_018174 | VCY2IP1 | VCY2 interacting protein 1 | Hypothetical protein | 3703 | 7671 |
| NM_018182 | FLJ10700 | hypothetical protein FLJ10700 | Hypothetical protein | 3704 | 7672 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_018191 | RCBTB1 | regulator of chromosome condensation (RCC1) and BTB (POZ) domain containing protein 1 | Hypothetical protein | 3705 | 7673 |
| NM_018194 | FLJ10724 | melanoma antigen recognized by T cells 2 | Hypothetical protein | 3706 | 7674 |
| NM_018195 | FLJ10726 | hypothetical protein FLJ10726 | Hypothetical protein | 3707 | 7675 |
| NM_018197 | ZFP64 | zinc finger protein 64 homolog (mouse) | Transcription regulation, Zinc-finger, Metal-binding, Nuclear protein, DNA-binding, Repeat, Alternative splicing | 3708 | 7676 |
| NM_018203 | FLJ10748 | hypothetical protein FLJ10748 | Hypothetical protein | 3709 | 7677 |
| NM_018208 | FLJ10761 | putative ethanolamine kinase | Transferase, Kinase | 3710 | 7678 |
| NM_018209 | ARFGAP1 | ADP-ribosylation factor GTPase activating protein 1 | Transport, Protein transport, GTPase activation, Golgi stack, Zinc-finger, Alternative splicing, Polymorphism | 3711 | 7679 |
| NM_018217 | C20orf31 | chromosome 20 open reading frame 31 | Hydrolase, Glycosidase, Glycoprotein, Signal, Polymorphism | 3712 | 7680 |
| NM_018226 | RNPEPL1 | arginyl aminopeptidase (aminopeptidase B)-like 1 | Aminopeptidase, Hydrolase, Zinc, Metalloprotease | 3713 | 7681 |
| NM_018235 | FLJ10830 | cytosolic nonspecific dipeptidase (EC 3.4.13.18) | Hydrolase, Carboxypeptidase, Metalloprotease, Hypothetical protein | 3714 | 7682 |
| NM_018243 | FLJ10849 | hypothetical protein FLJ10849 | Hypothetical protein | 3715 | 7683 |
| NM_018246 | FLJ10853 | hypothetical protein FLJ10853 | Hypothetical protein | 3716 | 7684 |
| NM_018255 | STATIP1 | signal transducer and activator of transcription 3 interacting protein 1 | Hypothetical protein, Repeat, WD repeat | 3717 | 7685 |
| NM_018256 | WDR12 | WD repeat domain 12 | Repeat, WD repeat, Polymorphism | 3718 | 7686 |
| NM_018257 | C20orf36 | chromosome 20 open reading frame 36 | Transcription regulation, Zinc-finger, DNA-binding, Nuclear protein, Repeat, Alternative splicing | 3719 | 7687 |
| NM_018259 | FLJ10890 | hypothetical protein FLJ10890 | Hypothetical protein | 3720 | 7688 |
| NM_018264 | FLJ10900 | hypothetical protein FLJ10900 | Hypothetical protein | 3721 | 7689 |
| NM_018265 | FLJ10901 | hypothetical protein FLJ10901 | Hypothetical protein | 3722 | 7690 |
| NM_018267 | H2AFJ | H2A histone family, member J | Hypothetical protein | 3723 | 7691 |
| NM_018275 | FLJ10925 | hypothetical protein FLJ10925 | Hypothetical protein | 3724 | 7692 |
| NM_018306 | FLJ11036 | hypothetical protein FLJ11036 | Hypothetical protein | 3725 | 7693 |
| NM_018317 | FLJ11082 | hypothetical protein FLJ11082 | Hypothetical protein | 3726 | 7694 |
| NM_018319 | TDP1 | tyrosyl-DNA phosphodiesterase 1 | Hypothetical protein, Hydrolase, DNA repair, Repeat, Nuclear protein, 3D-structure, Disease mutation | 3727 | 7695 |
| NM_018321 | RAD1 | BRIX | Hypothetical protein, Ribosome biogenesis, Nuclear protein, Cell cycle, Exonuclease | 3728 | 7696 |
| NM_018322 | C6orf64 | chromosome 6 open reading frame 64 | Hypothetical protein, Dynein | 3729 | 7697 |
| NM_018324 | FLJ11106 | hypothetical protein FLJ11106 | Hypothetical protein | 3730 | 7698 |
| NM_018326 | HIMAP4 | immunity associated protein 4 | GTP-binding, Coiled coil, Polymorphism | 3731 | 7699 |
| NM_018332 | DDX19 | hypothetical protein FLJ11126 | ATP-binding, Helicase, Hydrolase, RNA-binding, Nuclear protein, Hypothetical protein | 3732 | 7700 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_018333 | FLJ20666 | hypothetical protein FLJ20666 | Hypothetical protein | 3733 | 7701 |
| NM_018358 | FLJ11198 | ATP-binding cassette, sub-family F (GCN20), member 3 | Hypothetical protein, ATP-binding | 3734 | 7702 |
| NM_018359 | FLJ11200 | hypothetical protein FLJ11200 | Hypothetical protein | 3735 | 7703 |
| NM_018361 | FLJ11210 | acid acyltransferase-epsilon | Phospholipid biosynthesis, Transferase, Acyltransferase, Transmembrane | 3736 | 7704 |
| NM_018371 | ChGn | chondroitin beta1,4 N-acetylgalactosaminyl transferase | Transferase, Hypothetical protein | 3737 | 7705 |
| NM_018373 | SYNJ2BP | synaptojanin 2 binding protein | Mitochondrion, Outer membrane, Transmembrane | 3738 | 7706 |
| NM_018379 | FLJ11280 | hypothetical protein FLJ11280 | Hypothetical protein | 3739 | 7707 |
| NM_018386 | FLJ11305 | hypothetical protein FLJ11305 | Hypothetical protein | 3740 | 7708 |
| NM_018387 | STRBP | spermatid perinuclear RNA binding protein | Hypothetical protein | 3741 | 7709 |
| NM_018391 | FLJ23277 | ubiquitin specific protease 31 | Hypothetical protein, Protease | 3742 | 7710 |
| NM_018394 | FLJ11342 | hypothetical protein FLJ11342 | Hypothetical protein | 3743 | 7711 |
| NM_018399 | VNN3 | vanin 3 | Hydrolase, Signal, Glycoprotein, GPI-anchor, Lipoprotein | 3744 | 7712 |
| NM_018403 | HSA275986 | transcription factor SMIF | Hypothetical protein | 3745 | 7713 |
| NM_018404 | CENTA2 | centaurin, alpha 2 | GTPase activation, Repeat, Zinc-finger | 3746 | 7714 |
| NM_018407 | LAPTM4B | lysosomal associated protein transmembrane 4 beta | | 3747 | 7715 |
| NM_018421 | TBC1D2 | TBC1 domain family, member 2 | Hypothetical protein, GTPase activation, Antigen | 3748 | 7716 |
| NM_018422 | DKFZp761K1423 | hypothetical protein DKFZp761K1423 | Hypothetical protein | 3749 | 7717 |
| NM_018423 | DKFZp761p1010 | protein kinase STYK1 | ATP-binding, Kinase, Receptor, Transferase, Tyrosine-protein kinase, Hypothetical protein | 3750 | 7718 |
| NM_018441 | PECR | peroxisomal trans 2-enoyl CoA reductase | Oxidoreductase | 3751 | 7719 |
| NM_018443 | ZNF302 | zinc finger protein 302 | Hypothetical protein, Metal-binding, Zinc, Zinc-finger, Transcription regulation, DNA-binding, Nuclear protein, Repeat, Alternative splicing | 3752 | 7720 |
| NM_018449 | UBAP2 | ubiquitin associated protein 2 | Hypothetical protein | 3753 | 7721 |
| NM_018452 | C6orf35 | chromosome 6 open reading frame 35 | Hypothetical protein | 3754 | 7722 |
| NM_018457 | DKFZP564J157 | DKFZp564J157 protein | Hypothetical protein | 3755 | 7723 |
| NM_018465 | MDS030 | chromosome 9 open reading frame 46 | Hypothetical protein | 3756 | 7724 |
| NM_018472 | HT011 | uncharacterized hypothalamus protein HT011 | Hypothetical protein | 3757 | 7725 |
| NM_018480 | HT007 | uncharacterized hypothalamus protein HT007 | Hypothetical protein | 3758 | 7726 |
| NM_018485 | GPR77 | G protein-coupled receptor 77 | G-protein coupled receptor, Transmembrane, Glycoprotein | 3759 | 7727 |
| NM_018486 | HDAC8 | histone deacetylase 8 | Hydrolase, Nuclear protein, Chromatin regulator, Transcription regulation, Repressor, Alternative splicing | 3760 | 7728 |
| NM_018491 | LOC55871 | COBW-like protein | Hypothetical protein | 3761 | 7729 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_018515 | PRO2176 | EST, Highly similar to hypothetical protein PRO2176 [*Homo sapiens*] [*H. sapiens*] | | 3762 | 7730 |
| NM_018520 | PRO2268 | hypothetical protein PRO2268 | | 3763 | 7731 |
| NM_018533 | RAB7 | *Homo sapiens* cDNA FLJ20819 fis, clone ADSE00511. | GTP-binding, Lipoprotein, Prenylation, Protein transport, Hypothetical protein | 3764 | 7732 |
| NM_018556 | SIRPB2 | signal-regulatory protein beta 2 | Repeat, Signal, Transmembrane, Immunoglobulin domain, Glycoprotein, Alternative splicing | 3765 | 7733 |
| NM_018569 | PRO0971 | hypothetical protein PRO0971 | Hypothetical protein | 3766 | 7734 |
| NM_018572 | PRO1051 | E2F transcription factor 3 | | 3767 | 7735 |
| NM_018590 | PRO0082 | chondroitin sulfate GalNAcT-2 | Hypothetical protein, Transferase | 3768 | 7736 |
| NM_018594 | PRO0823 | FYN binding protein (FYB-120/130) | SH3 domain, Phosphorylation, Nuclear protein, Coiled coil, Alternative splicing | 3769 | 7737 |
| NM_018615 | PRO2032 | *Homo sapiens* hypothetical protein PRO2032 (PRO2032), mRNA. | | 3770 | 7738 |
| NM_018638 | EKI1 | ethanolamine kinase | Transferase, Kinase | 3771 | 7739 |
| NM_018643 | TREM1 | triggering receptor expressed on myeloid cells 1 | Receptor | 3772 | 7740 |
| NM_018648 | NOLA3 | nucleolar protein family A, member 3 (H/ACA small nucleolar RNPs) | | 3773 | 7741 |
| NM_018676 | THSD1 | thrombospondin, type I, domain 1 | Signal | 3774 | 7742 |
| NM_018687 | LOC55908 | hepatocellular carcinoma-associated gene TD26 | | 3775 | 7743 |
| NM_018688 | BIN3 | bridging integrator 3 | Septation, Cytoskeleton, Coiled coil, Hypothetical protein | 3776 | 7744 |
| NM_018690 | APOB48R | apolipoprotein B48 receptor | Hypothetical protein, Lipoprotein, Receptor | 3777 | 7745 |
| NM_018699 | PRDM5 | PR domain containing 5 | Transcription regulation, DNA-binding, Zinc-finger, Metal-binding, Nuclear protein, Repeat | 3778 | 7746 |
| NM_018728 | MYO5C | myosin VC | Myosin, Repeat, ATP-binding, Calmodulin-binding, Actin-binding, Coiled coil, Polymorphism | 3779 | 7747 |
| NM_018834 | MATR3 | matrin 3 | Nuclear protein, RNA-binding, Repeat, Zinc-finger | 3780 | 7748 |
| NM_018839 | NSFL1C | NSFL1 (p97) cofactor (p47) | Hypothetical protein | 3781 | 7749 |
| NM_018840 | C20orf24 | chromosome 20 open reading frame 24 | Alternative splicing, Membrane, SH2 domain, SH3 domain, Myristate, Phosphorylation, Alternative initiation, Lipoprotein | 3782 | 7750 |
| NM_018939 | PCDHB6 | protocadherin beta 6 | Calcium-binding, Cell adhesion, Glycoprotein, Signal, Repeat, Transmembrane, Multigene family | 3783 | 7751 |
| NM_018959 | DAZAP1 | DAZ associated protein 1 | Hypothetical protein | 3784 | 7752 |
| NM_018961 | UBASH3A | ubiquitin associated and SH3 domain containing, A | Nuclear protein, SH3 domain, Alternative splicing | 3785 | 7753 |
| NM_018983 | NOLA1 | nucleolar protein family A, member 1 (H/ACA small nucleolar RNPs) | | 3786 | 7754 |
| NM_018996 | FLJ20015 | KIAA1582 protein | Hypothetical protein | 3787 | 7755 |
| NM_019002 | ETAA16 | ETAA16 protein | | 3788 | 7756 |
| NM_019009 | TOLLIP | toll interacting protein | Hypothetical protein, Immune response, Inflammatory response | 3789 | 7757 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_019012 | PEPP2 | phosphoinositol 3-phosphate-binding protein-2 | Hypothetical protein | 3790 | 7758 |
| NM_019018 | FLJ11127 | hypothetical protein FLJ11127 | Hypothetical protein | 3791 | 7759 |
| NM_019042 | FLJ20485 | hypothetical protein FLJ20485 | Hypothetical protein, tRNA processing, Lyase | 3792 | 7760 |
| NM_019057 | FLJ10404 | hypothetical protein FLJ10404 | Hypothetical protein | 3793 | 7761 |
| NM_019063 | EML4 | echinoderm microtubule associated-protein like 4 | Microtubule, Repeat, WD repeat, Hypothetical protein | 3794 | 7762 |
| NM_019067 | FLJ10613 | hypothetical protein FLJ10613 | Hypothetical protein | 3795 | 7763 |
| NM_019084 | FLJ10895 | hypothetical protein FLJ10895 | Hypothetical protein | 3796 | 7764 |
| NM_019096 | GTPBP2 | GTP binding protein 2 | GTP-binding, Protein biosynthesis, Hypothetical protein | 3797 | 7765 |
| NM_019112 | ABCA7 | ATP-binding cassette, sub-family A (ABC1), member 7 | ATP-binding, Hypothetical protein | 3798 | 7766 |
| NM_019554 | S100A4 | S100 calcium binding protein A4 (calcium protein, calvasculin, metastasin, murine placental homolog) | Calcium-binding, 3D-structure | 3799 | 7767 |
| NM_019604 | CRTAM | class-I MHC-restricted T cell associated molecule | | 3800 | 7768 |
| NM_019848 | P3 | solute carrier family 10 (sodium/bile acid cotransporter family), member 3 | Transmembrane, Transport, Symport | 3801 | 7769 |
| NM_019892 | PPI5PIV | inositol polyphosphate-5-phosphatase, 72 kDa | | 3802 | 7770 |
| NM_019896 | POLE4 | polymerase (DNA-directed), epsilon 4 (p12 subunit) | DNA-directed DNA polymerase, DNA-binding, Nuclear protein | 3803 | 7771 |
| NM_020038 | ABCC3 | ATP-binding cassette, sub-family C (CFTR/MRP), member 3 | ATP-binding, Glycoprotein, Transmembrane, Transport, Repeat, Alternative splicing | 3804 | 7772 |
| NM_020123 | SMBP | SM-11044 binding protein | Hypothetical protein, Signal, Transmembrane | 3805 | 7773 |
| NM_020133 | LPAAT-delta | 1-acylglycerol-3-phosphate O-acyltransferase 4 (lysophosphatidic acid acyltransferase, delta) | Phospholipid biosynthesis, Transferase, Acyltransferase, Transmembrane | 3806 | 7774 |
| NM_020134 | DPYSL5 | dihydropyrimidinase-like 5 | Hypothetical protein | 3807 | 7775 |
| NM_020135 | WHIP | Werner helicase interacting protein 1 | ATP-binding, Helicase, Hypothetical protein | 3808 | 7776 |
| NM_020139 | LOC56898 | dehydrogenase/reductase (SDR family) member 6 | Oxidoreductase, Hypothetical protein | 3809 | 7777 |
| NM_020143 | LOC56902 | putatative 28 kDa protein | Hypothetical protein | 3810 | 7778 |
| NM_020149 | MEIS2 | Meis1, myeloid ecotropic viral integration site 1 homolog 2 (mouse) | Hypothetical protein, Homeobox, DNA-binding, Nuclear protein, Alternative splicing | 3811 | 7779 |
| NM_020152 | C21orf7 | chromosome 21 open reading frame 7 | Alternative splicing, Hypothetical protein | 3812 | 7780 |
| NM_020158 | RRP46 | exosome component Rrp46 | Exosome, Hydrolase, Nuclease, Exonuclease, rRNA processing, Nuclear protein, RNA-binding, Antigen | 3813 | 7781 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_020166 | MCCC1 | methylcrotonoyl-Coenzyme A carboxylase 1 (alpha) | Mitochondrion, Ligase, Biotin, ATP-binding, Transit peptide, Disease mutation, Polymorphism | 3814 | 7782 |
| NM_020179 | FN5 | FN5 protein | | 3815 | 7783 |
| NM_020184 | CNNM4 | cyclin M4 | Hypothetical protein | 3816 | 7784 |
| NM_020188 | DC13 | DC13 protein | | 3817 | 7785 |
| NM_020193 | C11ORF30 | chromosome 11 open reading frame 30 | Hypothetical protein | 3818 | 7786 |
| NM_020198 | GK001 | GK001 protein | Hypothetical protein | 3819 | 7787 |
| NM_020200 | HHGP | phosphoribosyl transferase domain containing 1 | Transferase | 3820 | 7788 |
| NM_020201 | NT5M | 5′,3′-nucleotidase, mitochondrial | Nucleotide metabolism, Hydrolase, Mitochondrion, Nucleotide-binding, Magnesium, Transit peptide, 3D-structure | 3821 | 7789 |
| NM_020216 | RNPEP | arginyl aminopeptidase (aminopeptidase B) | Aminopeptidase, Hydrolase, Zinc, Metalloprotease | 3822 | 7790 |
| NM_020229 | PRDM11 | PR domain containing 11 | Hypothetical protein | 3823 | 7791 |
| NM_020231 | MDS010 | x 010 protein | Hypothetical protein | 3824 | 7792 |
| NM_020234 | MDS009 | x 009 protein | Hypothetical protein | 3825 | 7793 |
| NM_020236 | MRPL1 | mitochondrial ribosomal protein L1 | Hypothetical protein, Ribosomal protein | 3826 | 7794 |
| NM_020239 | SPEC1 | small protein effector 1 of Cdc42 | Hypothetical protein | 3827 | 7795 |
| NM_020243 | TOMM22 | translocase of outer mitochondrial membrane 22 homolog (yeast) | Receptor, Translocation, Transport, Protein transport, Outer membrane, Mitochondrion, Transmembrane | 3828 | 7796 |
| NM_020313 | LOC57019 | hypothetical protein LOC57019 | Hypothetical protein | 3829 | 7797 |
| NM_020314 | MGC16824 | esophageal cancer associated protein | Hypothetical protein | 3830 | 7798 |
| NM_020322 | ACCN3 | amiloride-sensitive cation channel 3 | Ionic channel | 3831 | 7799 |
| NM_020344 | SLC24A2 | solute carrier family 24 (sodium/potassium/calcium exchanger), member 2 | Vision, Transport, Antiport, Symport, Calcium transport, Potassium transport, Sodium transport, Transmembrane, Glycoprotein, Signal, Repeat, Alternative splicing | 3832 | 7800 |
| NM_020347 | LZTFL1 | leucine zipper transcription factor-like 1 | | 3833 | 7801 |
| NM_020350 | AGTRAP | angiotensin II receptor-associated protein | Receptor | 3834 | 7802 |
| NM_020357 | PCNP | PEST-containing nuclear protein | Nuclear protein | 3835 | 7803 |
| NM_020360 | PLSCR3 | phospholipid scramblase 3 | Hypothetical protein, Transmembrane, Lipoprotein, Calcium-binding, SH3-binding, Repeat, Phosphorylation, Palmitate, Polymorphism | 3836 | 7804 |
| NM_020365 | EIF2B3 | eukaryotic translation initiation factor 2B, subunit 3 gamma, 58 kDa | Initiation factor, Protein biosynthesis, Alternative splicing, Disease mutation, Hypothetical protein | 3837 | 7805 |
| NM_020366 | RPGRIP1 | retinitis pigmentosa GTPase regulator interacting protein 1 | | 3838 | 7806 |
| NM_020370 | GPR84 | G protein-coupled receptor 84 | Receptor | 3839 | 7807 |
| NM_020371 | AVEN | apoptosis, caspase activation inhibitor | Apoptosis | 3840 | 7808 |
| NM_020385 | XPMC2H | XPMC2 prevents mitotic catastrophe 2 homolog (Xenopus laevis) | Hypothetical protein | 3841 | 7809 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_020390 | EIF5A2 | eukaryotic translation initiation factor 5A2 | Initiation factor, Hypothetical protein | 3842 | 7810 |
| NM_020394 | LOC57116 | zinc finger protein SBZF3 | Metal-binding, Zinc, Zinc-finger | 3843 | 7811 |
| NM_020399 | PIST | golgi associated PDZ and coiled-coil motif containing | Hypothetical protein | 3844 | 7812 |
| NM_020401 | NUP107 | nuclear pore complex protein | Nuclear protein, Transport | 3845 | 7813 |
| NM_020406 | PRV1 | polycythemia rubra vera 1 | Signal, Receptor | 3846 | 7814 |
| NM_020408 | CGI-203 | chromosome 6 open reading frame 149 | Hypothetical protein | 3847 | 7815 |
| NM_020410 | CGI-152 | cation-transporting ATPase | Hydrolase, Transmembrane, Phosphorylation, Magnesium, ATP-binding, Alternative splicing, Hypothetical protein | 3848 | 7816 |
| NM_020414 | DDX24 | DEAD (Asp-Glu-Ala-Asp) box polypeptide 24 | Hydrolase, Helicase, ATP-binding, RNA-binding | 3849 | 7817 |
| NM_020415 | RETN | resistin | Hormone, Signal, Diabetes mellitus, Obesity | 3850 | 7818 |
| NM_020466 | DJ122O8.2 | hypothetical protein dJ122O8.2 | Hypothetical protein | 3851 | 7819 |
| NM_020469 | ABO | ABO blood group (transferase A, alpha 1-3-N-acetylgalactosaminyl transferase; transferase B, alpha 1-3-galactosyltransferase) | Transferase, Glycosyltransferase, Blood group antigen, Golgi stack, Metal-binding, Manganese, Signal-anchor, Transmembrane, Glycoprotein, Polymorphism, 3D-structure | 3852 | 7820 |
| NM_020480 | ANK1 | ankyrin 1, erythrocytic | ANK repeat, Repeat, Cytoskeleton, Alternative splicing, Phosphorylation, Lipoprotein, Disease mutation, Elliptocytosis, Polymorphism | 3853 | 7821 |
| NM_020484 | AF011757 | *Homo sapiens* RAGE binding protein (AF011757), mRNA. | | 3854 | 7822 |
| NM_020530 | OSM | oncostatin M | Growth regulation, Cytokine, Glycoprotein, Signal, 3D-structure | 3855 | 7823 |
| NM_020533 | MCOLN1 | mucolipin 1 | Hypothetical protein, Ionic channel, Transmembrane | 3856 | 7824 |
| NM_020548 | DBI | diazepam binding inhibitor (GABA receptor modulator, acyl-Coenzyme A binding protein) | Transport, Lipid-binding, Acetylation, Alternative splicing | 3857 | 7825 |
| NM_020632 | ATP6V0A4 | ATPase, H+ transporting, lysosomal V0 subunit a isoform 4 | Hydrogen ion transport, Transmembrane, Glycoprotein, Disease mutation, Hypothetical protein | 3858 | 7826 |
| NM_020639 | ANKRD3 | ankyrin repeat domain 3 | ANK repeat, Repeat, Hypothetical protein, ATP-binding, Kinase, Serine/threonine-protein kinase, Transferase, Alternative splicing | 3859 | 7827 |
| NM_020648 | TWSG1 | twisted gastrulation homolog 1 (*Drosophila*) | Hypothetical protein, Signal | 3860 | 7828 |
| NM_020652 | ZNF286 | zinc finger protein 286 | Transcription regulation, Zinc-finger, Metal-binding, Nuclear protein, DNA-binding, Repeat | 3861 | 7829 |
| NM_020659 | TTYH1 | tweety homolog 1 (*Drosophila*) | | 3862 | 7830 |
| NM_020664 | DECR2 | 2,4-dienoyl CoA reductase 2, peroxisomal | Hypothetical protein, Oxidoreductase | 3863 | 7831 |
| NM_020686 | NPD009 | 4-aminobutyrate aminotransferase | | 3864 | 7832 |
| NM_020905 | RDH14 | retinol dehydrogenase 14 (all-trans and 9-cis) | Oxidoreductase, NADP | 3865 | 7833 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_020980 | AQP9 | aquaporin 9 | Transport, Repeat, Transmembrane | 3866 | 7834 |
| NM_020983 | ADCY6 | adenylate cyclase 6 | Lyase, cAMP biosynthesis, Transmembrane, Glycoprotein, Repeat, Metal-binding, Magnesium, Alternative splicing | 3867 | 7835 |
| NM_020995 | HPR | haptoglobin-related protein | Hydrolase, Protease, Serine protease | 3868 | 7836 |
| NM_020999 | NEUROG3 | neurogenin 3 | | 3869 | 7837 |
| NM_021018 | HIST1H3F | histone 1, H3f | Nuclear protein, Chromosomal protein, DNA-binding, Nucleosome core, Multigene family, Acetylation, Methylation | 3870 | 7838 |
| NM_021019 | MYL6 | myosin, light polypeptide 6, alkali, smooth muscle and non-muscle | Myosin, Muscle protein, Acetylation, Alternative splicing, Multigene family | 3871 | 7839 |
| NM_021025 | TLX3 | T-cell leukemia, homeobox 3 | Homeobox, DNA-binding, Nuclear protein, Developmental protein | 3872 | 7840 |
| NM_021031 | CYCL | Homo sapiens cytochrome c-like antigen (CYCL), mRNA | Hypothetical protein | 3873 | 7841 |
| NM_021039 | S100A14 | S100 calcium binding protein A14 (calgizzarin) | Transcription regulation, DNA-binding, Nuclear protein, Hypothetical protein, Calcium-binding | 3874 | 7842 |
| NM_021074 | NDUFV2 | NADH dehydrogenase (ubiquinone) flavoprotein 2, 24 kDa | Oxidoreductase, NAD, Ubiquinone, Mitochondrion, Transit peptide, Metal-binding, Iron-sulfur, Iron, 2Fe—2S, Polymorphism | 3875 | 7843 |
| NM_021075 | NDUFV3 | NADH dehydrogenase (ubiquinone) flavoprotein 3, 10 kDa | Hypothetical protein | 3876 | 7844 |
| NM_021078 | GCN5L2 | GCN5 general control of amino-acid synthesis 5-like 2 (yeast) | Transcription regulation, Transferase, Nuclear protein, Bromodomain, Alternative splicing, 3D-structure | 3877 | 7845 |
| NM_021079 | NMT1 | N-myristoyltransferase 1 | Acyltransferase, Transferase, Alternative splicing | 3878 | 7846 |
| NM_021090 | MTMR3 | myotubularin related protein 3 | Hydrolase, Zinc-finger, Alternative splicing | 3879 | 7847 |
| NM_021103 | TMSB10 | thymosin, beta 10 | Actin-binding, Cytoskeleton, Acetylation | 3880 | 7848 |
| NM_021106 | RGS3 | regulator of G-protein signalling 3 | Hypothetical protein, Signal transduction inhibitor, Alternative splicing, Phosphorylation | 3881 | 7849 |
| NM_021131 | PPP2R4 | protein phosphatase 2A, regulatory subunit B' (PR 53) | Alternative splicing | 3882 | 7850 |
| NM_021173 | POLD4 | polymerase (DNA-directed), delta 4 | DNA-directed DNA polymerase, DNA replication, Nuclear protein | 3883 | 7851 |
| NM_021178 | HEI10 | chromosome 14 open reading frame 18 | Ubl conjugation pathway, Ligase, Nuclear protein, Metal-binding, Zinc, Coiled coil, Zinc-finger, Phosphorylation, Ubl conjugation | 3884 | 7852 |
| NM_021197 | WFDC1 | WAP four-disulfide core domain 1 | Serine protease inhibitor, Signal | 3885 | 7853 |
| NM_021198 | NLI-IF | CTD (carboxy-terminal domain, RNA polymerase II, polypeptide A) small phosphatase 1 | Hypothetical protein, Nuclear protein | 3886 | 7854 |
| NM_021199 | SQRDL | sulfide quinone reductase-like (yeast) | Oxidoreductase, Flavoprotein, FAD, NADP, Mitochondrion, Transit peptide, Polymorphism | 3887 | 7855 |
| NM_021212 | ZF | HCF-binding transcription factor Zhangfei | DNA-binding, Nuclear protein | 3888 | 7856 |
| NM_021238 | TERA | TERA protein | Hypothetical protein | 3889 | 7857 |
| NM_021242 | STRAIT11499 | MID1 interacting G12-like protein | Hypothetical protein | 3890 | 7858 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| NM_021251 | CAPN10 | calpain 10 | Hydrolase, Thiol protease, Repeat, Alternative splicing, Polymorphism, Diabetes mellitus | 3891 | 7859 |
| NM_021259 | TMEM8 | transmembrane protein 8 (five membrane-spanning domains) | Cell adhesion, Signal, Transmembrane, EGF-like domain, Glycoprotein | 3892 | 7860 |
| S73288 | small proline-rich protein SPRK | small proline-rich protein 1A | | 3893 | 7861 |
| S74639 | IGHM | Clone I50 immunoglobulin heavy chain variable region mRNA, partial cds | Immunoglobulin domain, Immunoglobulin C region, Glycoprotein, Repeat, Pyrrolidone carboxylic acid, Polymorphism, Membrane, Hypothetical protein, Receptor, T-cell, Signal | 3894 | 7862 |
| S77356 | ATP5O | ATP synthase, H+ transporting, mitochondrial F1 complex, O subunit (oligomycin sensitivity conferring protein) | Hydrolase, ATP synthesis, CF(1), Hydrogen ion transport, Mitochondrion, Transit peptide, Polymorphism | 3895 | 7863 |
| S80864 | cytochrome c-like polypeptide | cytochrome c-like antigen | Hypothetical protein | 3896 | 7864 |
| S90469 | POR | P450 (cytochrome) oxidoreductase | Oxidoreductase, Flavoprotein, FMN, FAD, NADP, Endoplasmic reticulum, Membrane, Acetylation, Polymorphism, 3D-structure | 3897 | 7865 |
| U00946 | KIAA0344 | protein kinase, lysine deficient 1 | Hypothetical protein, ATP-binding, Kinase, Serine/threonine-protein kinase, Transferase | 3898 | 7866 |
| U01147 | ABR | active BCR-related gene | Guanine-nucleotide releasing factor, Alternative splicing | 3899 | 7867 |
| U02032 | RPL23A | ribosomal protein L23a | Ribosomal protein, rRNA-binding | 3900 | 7868 |
| U09196 | POLD4 | polymerase (DNA-directed), delta 4 | DNA-directed DNA polymerase, DNA replication, Nuclear protein | 3901 | 7869 |
| U14383 | MUC8 | Human mucin (MUC8) mRNA, partial cds. | | 3902 | 7870 |
| U20180 | IREB2 | iron-responsive element binding protein 2 | Iron-sulfur, 4Fe—4S, RNA-binding, Hypothetical protein | 3903 | 7871 |
| U25750 | | hypothetical protein MGC20235 | Hypothetical protein | 3904 | 7872 |
| U36759 | PTCRA | pre T-cell antigen receptor alpha | | 3905 | 7873 |
| U37689 | POLR2H | polymerase (RNA) II (DNA directed) polypeptide H | Transferase, DNA-directed RNA polymerase, Transcription, Nuclear protein | 3906 | 7874 |
| U41387 | DDX21 | DEAD (Asp-Glu-Ala-Asp) box polypeptide 21 | Helicase, RNA-binding, ATP-binding, Nuclear protein, Antigen, Repeat | 3907 | 7875 |
| U43431 | TOP3A | topoisomerase (DNA) III alpha | Isomerase, Topoisomerase, DNA-binding, Repeat, Zinc-finger, Alternative splicing, Polymorphism | 3908 | 7876 |
| U43604 | | Human unidentified mRNA, partial sequence. | | 3909 | 7877 |
| U56725 | HSPA2 | Human heat shock protein mRNA, complete cds. | ATP-binding, Chaperone, Heat shock, Multigene family | 3910 | 7878 |
| U58033 | MTMR2 | myotubularin related protein 2 | Hydrolase, Charcot-Marie-Tooth disease | 3911 | 7879 |
| U64205 | MARK3 | MAP/microtubule affinity-regulating kinase 3 | Transferase, Serine/threonine-protein kinase, ATP-binding, Alternative splicing, Plasmid | 3912 | 7880 |
| U66702 | PTPRN2 | protein tyrosine phosphatase, receptor type, N polypeptide 2 | Hypothetical protein, Hydrolase, Receptor, Glycoprotein, Signal, Transmembrane, Diabetes mellitus, Alternative splicing | 3913 | 7881 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| U68382 | MAN2B1 | mannosidase, alpha, class 2B, member 1 | Glycosidase, Hydrolase, Glycoprotein, Lysosome, Zymogen, Signal, Disease mutation, Polymorphism | 3914 | 7882 |
| U68494 | | solute carrier family 30 (zinc transporter), member 1 | | 3915 | 7883 |
| U69127 | FUBP3 | far upstream element (FUSE) binding protein 3 | Transcription regulation, Transacting factor, Nuclear protein, DNA-binding, Repeat, Alternative splicing | 3916 | 7884 |
| U69645 | ZNF32 | zinc finger protein 32 (KOX 30) | Hypothetical protein, Metal-binding, Zinc, Zinc-finger, Transcription regulation, DNA-binding, Nuclear protein, Repeat | 3917 | 7885 |
| U72882 | IFI35 | interferon-induced protein 35 | Interferon induction, Alternative splicing | 3918 | 7886 |
| U79246 | DIS3 | FLJ22624 protein | Hypothetical protein | 3919 | 7887 |
| U79260 | MGC5149 | fatso | Hypothetical protein | 3920 | 7888 |
| U79277 | | tyrosine 3-monooxygenase/tryptophan 5-monooxygenase activation protein, zeta polypeptide | Neurone, Phosphorylation, Acetylation, Multigene family, 3D-structure | 3921 | 7889 |
| U79280 | PIPPIN | RNA-binding protein pippin | Hypothetical protein, mRNA processing, RNA-binding, Nuclear protein | 3922 | 7890 |
| U79282 | | hypothetical protein LOC137886 | Hypothetical protein | 3923 | 7891 |
| U79290 | | Human clone 23908 mRNA sequence | | 3924 | 7892 |
| U79298 | MGC39325 | hypothetical protein MGC39325 | Hypothetical protein | 3925 | 7893 |
| U79458 | WBP2 | Human WW domain binding protein-2 mRNA, complete cds. | Hypothetical protein | 3926 | 7894 |
| U80628 | TK2 | thymidine kinase 2, mitochondrial | Kinase, Transferase, DNA synthesis, ATP-binding, Mitochondrion, Transit peptide, Alternative splicing | 3927 | 7895 |
| U82277 | LILRA2 | leukocyte immunoglobulin-like receptor, subfamily B (with TM and ITIM domains), member 1 | Immune response, Receptor, Repeat, Signal, Transmembrane, Immunoglobulin domain, Glycoprotein, Antigen, Alternative splicing, Polymorphism, Multigene family, Phosphorylation, 3D-structure | 3928 | 7896 |
| U83115 | AIM1 | absent in melanoma 1 | Repeat, Lectin | 3929 | 7897 |
| U90878 | PDLIM1 | PDZ and LIM domain 1 (elfin) | Cytoskeleton, LIM domain, Metal-binding, Zinc | 3930 | 7898 |
| U90909 | MISS | chromosome 14 open reading frame 32 | Hypothetical protein | 3931 | 7899 |
| U90911 | WIRE | WIRE protein | | 3932 | 7900 |
| U90916 | | sortilin-related receptor, L(DLR class) A repeats-containing | Endocytosis, Receptor, Transmembrane, EGF-like domain, Repeat, Glycoprotein, LDL, Lipid transport, Cholesterol metabolism, Signal | 3933 | 7901 |
| W61000_RC | NORE1 | Ras association (RalGDS/AF-6) domain family 5 | Hypothetical protein | 3934 | 7902 |
| X00437 | IGHM | Human mRNA for T-cell specific protein. | Immunoglobulin domain, Immunoglobulin C region, Glycoprotein, Repeat, Pyrrolidone carboxylic acid, Polymorphism, Membrane, Hypothetical protein, Receptor, T-cell, Signal | 3935 | 7903 |
| X04201 | TPM3 | tropomyosin 3 | Hypothetical protein, Muscle protein, Cytoskeleton, Actin-binding, Coiled coil, Alternative splicing, Multigene family, Disease mutation | 3936 | 7904 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| X04526 | GNB1 | Human liver mRNA for beta-subunit signal transducing proteins Gs/Gi (beta-G). | Transducer, Repeat, WD repeat, Multigene family, 3D-structure | 3937 | 7905 |
| X07618 | CYP2D6 | cytochrome P450, family 2, subfamily D, polypeptide 6 | Heme, Monooxygenase, Oxidoreductase, Electron transport, Membrane, Microsome, Endoplasmic reticulum, Polymorphism | 3938 | 7906 |
| X13956 | MGC10471 | hypothetical protein MGC10471 | | 3939 | 7907 |
| X15183 | HSPCA | heat shock 90 kDa protein 1, alpha | Heat shock, Chaperone, ATP-binding, Phosphorylation, 3D structure, Hypothetical protein, Plasmid | 3940 | 7908 |
| X51630 | WT1 | Wilms tumor 1 | Zinc-finger, Metal-binding, DNA-binding, Repeat, Nuclear protein, Transcription regulation, Alternative splicing, Anti-oncogene, Disease mutation, Chromosomal translocation, 3D-structure | 3941 | 7909 |
| X52015 | IL1RN | interleukin 1 receptor antagonist | Glycoprotein, Signal, Alternative splicing, 3D-structure | 3942 | 7910 |
| X52882 | TCP1 | t-complex 1 | Chaperone, ATP-binding, Multigene family | 3943 | 7911 |
| X56789 | TTS-2.2 | transport-secretion protein 2.2 | Hypothetical protein | 3944 | 7912 |
| X57352 | IFITM3 | interferon induced transmembrane protein 3 (1-8 U) | Interferon induction, Transmembrane | 3945 | 7913 |
| X58536 | HLA-C | major histocompatibility complex, class I, C | Glycoprotein, Signal, Transmembrane, Hypothetical protein, MHC, MHC I, Polymorphism, 3D-structure, Alternative splicing | 3946 | 7914 |
| X58794 | AZU1 | azurocidin 1 (cationic antimicrobial protein 37) | Serine protease homolog, Glycoprotein, Chemotaxis, Antibiotic, Heparin-binding, Signal, 3D-structure | 3947 | 7915 |
| X59417 | PSMA6 | proteasome (prosome, macropain) subunit, alpha type, 6 | Proteasome, Hydrolase, Protease, Threonine protease | 3948 | 7916 |
| X61079 | IGHM | T cell receptor alpha-chain (TCR Valpha20Jalpha9.14) mRNA, partial cds. | Immunoglobulin domain, Immunoglobulin C region, Glycoprotein, Repeat, Pyrrolidone carboxylic acid, Polymorphism, Membrane, Hypothetical protein, Receptor, T-cell, Signal | 3949 | 7917 |
| X62535 | DGKA | diacylglycerol kinase, alpha 80 kDa | Hypothetical protein, Kinase, Transferase, Calcium-binding, Phorbol-ester binding, Repeat, Multigene family | 3950 | 7918 |
| X63417 | IRLB | c-myc promoter-binding protein | DNA-binding, Hypothetical protein | 3951 | 7919 |
| X69115 | ZNF37A | zinc finger protein 37a (KOX 21) | Hypothetical protein, Metal-binding, Nuclear protein, Zinc, Zinc-finger, Transcription regulation, DNA-binding, Repeat | 3952 | 7920 |
| X71490 | ATP6V0D1 | *H. sapiens* mRNA for vacuolar proton ATPase, subunit D. | Hydrolase, ATP synthesis, Hydrogen ion transport | 3953 | 7921 |
| X78817 | ARHGAP4 | Rho GTPase activating protein 4 | GTPase activation, SH3 domain, Coiled coil | 3954 | 7922 |
| X87949 | HSPA5 | heat shock 70 kDa protein 5 (glucose-regulated protein, 78 kDa) | ATP-binding, Endoplasmic reticulum, Signal | 3955 | 7923 |

TABLE 8-continued

The phase reporter genes

| SUBS | GENE | DESCRIPTION | SP_XREF_KEYWORD_LIST | SEQ ID NO. | PROBE SEQ ID NO. |
|---|---|---|---|---|---|
| X89214 | hpr | H. sapiens mRNA for haptoglobin related protein. | Hydrolase, Protease, Serine protease | 3956 | 7924 |
| X94232 | MAPRE2 | microtubule-associated protein, RP/EB family, member 2 | T-cell | 3957 | 7925 |
| X98258 | MPHOSPH9 | M-phase phosphoprotein 9 | Phosphorylation, Golgi stack, Membrane, Coiled coil | 3958 | 7926 |
| X98261 | ZWINTAS | ZW10 interactor | Phosphorylation, Nuclear protein, Coiled coil | 3959 | 7927 |
| X98411 | MYO1F | myosin IF | Myosin, ATP-binding, Actin-binding, Calmodulin-binding, SH3 domain, Multigene family | 3960 | 7928 |
| Y00433 | GPX1 | glutathione peroxidase 1 | Oxidoreductase, Peroxidase, Selenium, Selenocysteine, Erythrocyte, Polymorphism, Hypothetical protein | 3961 | 7929 |
| Y00816 | CR1 | complement component (3b/4b) receptor 1, including Knops blood group system | Complement pathway, Glycoprotein, Transmembrane, Repeat, Signal, Receptor, Sushi, Blood group antigen, Polymorphism, Pyrrolidone carboxylic acid, 3D-structure | 3962 | 7930 |
| Y14442 | OR1F1 | olfactory receptor, family 1, subfamily F, member 1 | G-protein coupled receptor, Transmembrane, Glycoprotein, Multigene family, Olfaction | 3963 | 7931 |
| Y18490 | LST1 | leukocyte specific transcript 1 | Immune response, Cell shape, Transmembrane, Alternative splicing | 3964 | 7932 |
| Z15114 | PRKCG | protein kinase C, gamma | Transferase, Serine/threonine-protein kinase, ATP-binding, Calcium-binding, Metal-binding, Zinc, Repeat, Phorbol-ester binding, Phosphorylation, Polymorphism | 3965 | 7933 |
| Z34893 | IGHM | Clone P2-114 anti-oxidized LDL immunoglobulin heavy chain Fab mRNA, partial cds | Immunoglobulin domain, Immunoglobulin C region, Glycoprotein, Repeat, Pyrrolidone carboxylic acid, Polymorphism, Membrane, Hypothetical protein, Receptor, T-cell, Signal | 3966 | 7934 |
| Z48314 | MUC5AC | mucin 5, subtypes A and C, tracheobronchial/gastric | Repeat, Glycoprotein, Signal, Polymorphism, Hypothetical protein | 3967 | 7935 |
| Z49105 | SSX2 | synovial sarcoma, X breakpoint 2 | Chromosomal translocation, Proto-oncogene, Multigene family, Transcription regulation | 3968 | 7936 |

7. REFERENCES CITED

All references cited herein are incorporated herein by reference in their entirety and for all purposes to the same extent as if each individual publication or patent or patent application was specifically and individually indicated to be incorporated by reference in its entirety for all purposes.

Many modifications and variations of the present invention can be made without departing from its spirit and scope, as will be apparent to those skilled in the art. The specific embodiments described herein are offered by way of example only, and the invention is to be limited only by the terms of the appended claims along with the full scope of equivalents to which such claims are entitled.

SEQUENCE LISTING (7936 sequences)

SEQ ID NO: 1 - DNA, 6629 bp, Homo sapiens
tggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctggagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtac

SEQ ID NO: 2 - DNA, 6252 bp, Homo sapiens
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctcgagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactccg

SEQ ID NO: 3 - DNA, 6934 bp, Homo sapiens
tttccagccaacgccaaacagtgactgttgacaatttcatattgtcatcaggggaaccaaggcttattcagatgcctatttcagaacctaggacagttccattgaaaaggcgcaggcgttcgggctggctgactagatggatcaggcctggctgcctgatggctatattcctccttcctccctctccacttccatctcaacccttgaggctgcatattgaatagttggagaattcagtgaactaagagatgcaaatgcacagtacaaaattcaaatgtccaattcggggcagggctgcatctaactttaatggcaaccactgcatgtgatgtctggggactctatagatacatggcctcagaccctgaagacatctggattctgtcactggattgttcacaaagtgaggctgaactttccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacaggtgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacactgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagtgatggctactgtaatcatgggagccatgagtaaatagttaagtatttattaaataaatacttaatctggattggctgataaaaatatgaaatct

SEQ ID NO: 4 - DNA, 6692 bp, Homo sapiens
gagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctggtcccgggcctgtccccacccagctgcctgtcctctggcaggtattggaaattgctgtgtctagaagcatctctgccttcacactcttgcactgcattagctgcaaggtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccacggcagcctcaaagaaaacagcccctccaggctccacggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcgacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtaagcgccggctttctgggtggaggtgaggcccacctgcacctgcacccctcctcccactgacatgccctgctgagtcctgaccagcccagggctctctgggagcaggagttaggagcacagacgcagcggttagcaataggattcatctttgagggcgtaggactgtggcacgagaagtacccctgattcacagcataaattgtcttaggagagttttttagagagggaaaaacccacagcctgcaaccagctcatcttggcctcaggtcagagaagactcagtgcccaggagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaatagttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctccgtggccatgcagtccccagaggattggtgttctctcaaagcgggtgtgtggatcacacagtgtcctctaaagtgcttcgtcataaaggcaggtgctgtctggaccctgtgcctcagtgccctctgtccctgtcaccaggcctcggcgggtgttcctgccatagctgtgcagggtgttcccacccacacccctcatgccgcaccctagctagctggggtcctgtaggggccactccacatcttgggcgggacttctgtcgccccaggcacagcccacgttcctactggagcccattcttcacagctggagtgggctcagcctatgcctgtgttgtggaattatatgtccataaagggattggttggtatcagtaatttcagggttaaatatttgctggcgtagtgcattaaattattttagtgccagataaatttttaaaagcaaagtgctttagtgtgtcccctcaaatcctacttgggataaagagatgccacctaatgggtggcagaaaggaccctggtagaggttcttggtgttgcttgtgaagagctctggccagctccacgtgaccagggagaggaaaagcccggccctcctggaggtgaagaccgagaagctggcctctccgcacctgtgaagacccactggtcagttgcaagtgcgacagtgtgtgcactcagtgcagacactgcagcacctcagcacctccctaccggggtggaaagagcactttttctttacagaaacatgattcttagatagcgagcctcccctttttaaaacaattgaagcgatatttcatcctttcttgagcttctctccctgctcatctccaaacttggagctgtcaggtgagcacaggttgtagggtgttgagcgagccccggcgcatgccgggcaccgggttccccacactgggcagtgacggggcccagggaggccaccagaggagcggcgcctccattctccccacagcaagggctggctgtgcaggtgcagccccggggcagagggaaaggacaggtctcccagcacctcccggatggcaccgggacaaggagggctgggctggggtcactcaccttgtctgctgagtgcgatggcaccaaccacccacactgtcagctccgcgaccagctgggggaacgtcacactcgcccaccaaggcacttgctgaggccacgacgccgcctgacggggacacacaaaagccccagggactttgatccacgataaagagcagaggcgtctgggtaaagtaacacagggcaagggactttagaaaagtaacagctagtgaaacctttccatacacttcagaaatgttttaacttaagacttcagtataatgttaacttctcctgatgtccttgttgacatgaatgcgtgtgcgtgaaatctcacacacttccatggtcactaaacagccttcaccccgggccaggccatcgggtactcggcccgcttcacgtactgattacttgacttggcgttttctagatataaacatgtacatgtgtgtcctggctttgtggtgtaaatgtgtagtgcgtgtgcatgtgcgcgcgtgtgtgtgtgtaaggctaggtcctggcacgtttcccctgtctcagcggaccctgtcctcacggagatagcccagaagcccttggacagcacaggccacacctgagggtgctgatggtggtgactccacagagctgtggtcaggggtgagcatgtgctgcgcagcttggagtcacgcccccagaagtgctgggtgagggtctgcaggacccagctccattccacagcctcagttctctgcggcacatgcagcacaggcctgaaggagacctggcgccccagccttgagctgcccgtctgcatcagggcactgatgtgggagcatcttcccctggggatgttaaggagaaggtcctgttgggggtagagattcacgcagaaaagagtgactgactcgtccgtgtgcctcagtttataccacacaattgcaggtgtccatgcctcccacacatggggacctagtgggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacagtggggggcagctgggaggcctggttccaggtgaccttctccacctagatgttcaccccactcagttccagctttaccaacagggccccccgcaggaacttggggtcgcagagtcccggcctgtctcagggccttgttcatggaagggagatgagtcaggttgaaagctcatcgtgtagggttctgtgcggggcccttacaggactggaccgcagccaagatgcctgcctgttaaccatgcccagcccccgtcatttccgcgtgaagccgcaggcctcggagccttggtctgaaatgcctgtggagtaacctcggtccataaacatgggtgcacagtctgttctccccaagtacagggcaggaggaaacaccgccctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatgg

SEQ ID NO: 5 - DNA, 6263 bp, Homo sapiens
catcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccat

SEQ ID NO: 6 - DNA, 6447 bp, Homo sapiens
atcctcagaattcctcgggtccctcgatactcggctgaaaattctcatcggactctgagaggagcgctgggctggaggcattttccccagggacagaagcgggctattctctcacttgggccagtaagaaaaatccaaaaaaagttgtcgactctgccagcagggattggctaacgggccgttattttcttgactccaccaaggcggatgaaggggaggctacggctgaggccgggaacagtggcgaatctgcagcctctcagaatttggcagtgcaaggaagggacggggaagagaagcaaagcggcgcgcatcctgtccagcgattcgccccgcccgcccggtgaatctgcgtctgcagaacgcgccactgaaggttccccagcgctggctggcctcctcccctccgccccgccccttttcctcagggactagtcgcagctttcgtcgccgccgattcgtcaaggtcccgggccgcagcatctagatcgtcgtggcgaagccgactctccgggggatgcggccaatctccaagctccctgggccgcaacttccgagcctcccagggcgccggccgaggcgaagccgctaccctcggccccgtgggtcccccggcagcgcctgtggcgaaagtgcgaatgcagaccctgtgcccgctgggcctcgcgcagtgtaaatgagcaaagatggatcaggaaggtgggggagatgggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacacaagcttctccagcagccgacaagataccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccactgcctcatcctccgcctcttcctcctcattgtcctcgtcctcctcgtcatcctcttcctcctcgtcctctcagtttcgtagttctgatgcaaactacccagcgtattatgaaagctggaatcgctaccagcgccatacttcctacccaccacgccgggccacacgggaggaaccccctggagccccttttgctgaaaatacagctgagcgcttcccaccttcttacacctcctacctgccccccgagcccagccggcccaccgaccaggactaccggcctcctgcctcagaggctccacccccggagcctccagaacctggtggaggcgggggtggaggagggcccagccctgagagagaagaagttcggacttccccccgcccagcctcccctgcccgctctggctccccagccccggagaccaccaatgagagtgtgcccttcgcccagcacagcagcctggattcccgcatcgagatgctgctgaaggagcagcgctccaagttttccttcttggcctctgacacagaggaggaggaagagaacagcagcatggtccttggggccagagatacagggagtgaggtgccttctgggtcagggcatgggccctgcacaccccctccggccccagctaattttgaggatgtggcacctacagggagcggggagccaggggctacccgggagtctcccaaggcaaatggacagaaccaggcttctccatgctcttctggagacgacatggagatctccgacgacgaccggggtggctcaccccctccggccccgacgccccctcagcagcctccgccacctccccctcccccgccgcctcctcctccctacctggcgtcccttcctcttggttatcctccccaccaacctgcctacctcctcccacccagacctgatgggccgccgccccctgagtaccccccacctcctccaccacccccgcacatctatgactttgtgaactccttggagctcatggaccgacttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtaaagcggaaagagccatcggaaatttccgaggccagtgaggaaaagaggcctcgtccctccactcctgctgaggaagatgaagacgaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcacccgccgccctcttcagttccccagctgatgaggtcctggaggcccccgaggtggtggtggctgaggcggaggagcccaagccgcagcaactgcagcagcagcgggaggagggcgaagaggagggggaggaagagggggaggaagaggaggaggagtcctctgacagcagcagcagcagcgatggggagggcgccctccggaggcgcagcctccgctcccacgcccggcgccgccgccctccgcccccacccccgccgccaccgccccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaatcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggggacgaaccgcgtgctgtccgagcgccggtccgagcagcggcggctgctgagcgccatcggtacctccgccatcatggacagtgacctgctgaaactcaaccagctcaagttccggaagaagaagctccgatttggccggagccggatccacgagtggggtctgtttgccatggaacccattgctgctgacgagatggtcatcgaatacgtgggtcagaacatccgtcagatggtggccgacatgcgggagaagcgctacgtgcaggagggcattggcagcagctacctgttccgggtggaccacgacaccatcatcgatgccaccaagtgtggcaacctggccagattcatcaaccactgctgcacgcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcgcccctgcccaccaccccctgattgtttttctttgcggagaagaagctgtaaatgttttgtagcagccagcagctgtttcctgtggaaacctggggtgccggcctgtacagattctgtcctggggggctacacagtcctctcgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtac

SEQ ID NO: 7 - DNA, 5248 bp, Homo sapiens
ccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctgggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctc

SEQ ID NO: 8 - DNA, 5338 bp, Homo sapiens
ggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccagggggatgcccccccgacacccccgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctccgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctctatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgatgatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctctttttttttttttttttgaggcagtctcactctgtcacccaggctggagtgcagtggcgtgatctcggcccactgcaacctctgcctcctgggttcaagcaattttcctgcctcagcctcccgagtagctgggagtacaggcacacaccaccacacccagctaatttttgtatttttagtagagatagggtttcaccgtgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgccaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttg

SEQ ID NO: 9 - DNA, 5391 bp, Homo sapiens
cgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcattcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaaatgcagggacttgatttttttaaagagcttcactgaattaggatatttttattgcttttaaagaaaatacaaagttgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgcc

SEQ ID NO: 10 - DNA, 5665 bp, Homo sapiens
agctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacg

SEQ ID NO: 11 - DNA, 5724 bp, Homo sapiens
attgaatttaagttctaaggaggtggctgggtttcttattgtcaccttttgtcttgtctcatttagctatatcgagaagtttactgactttcttcggctctttgtgagtgttcacctaagaagaatcgagtcttactcccagttccctgtggtggagtttttgacacttttgttcaagtacacatttcatcagcctactcatgaaggctacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccatgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggtgaggagagaaagaggccgggctaagaggagggcagagtgggcacgcaagcctggcacctgtgcagcaaggagggggcacattgaggcctctgggcgtggtctgtgcccaccctgcagcttggcggcagctcacgagatgcctgctgacctggtgctgtagcctgattgaggggcacagccttttccccagtcttggtgtctgtagcacgtatgttcttagtctcagccatggaggtcccgagttcctggctctgcagcccctccatttgtcttggcatctttgttcatacccaggaccctgccgttctccctcctgggtgatgagccccggtggggccagcattggagtgtgcccaggcttgcattcaggctgagatggttggtgcttgggagctgcacttctgggtccccagggttagaggtgggacccaggttccccggctgtcttgggctctttccagaccagccccagctcagcttgggctgagttgctgccaggtcctgggaggagccctcctagtactcaccctcttgtcccactgctgccacctgtgcagggactgtcaggtgggctgtccccacccgtgcagcacctcggtgggagctgggtgctgctggctcttggtgtccatgaggccatcttgttggagcctgacagtgcctgggacctccttccccatggggctcacctgttctcttcttcctgtgtcaggtgaccaggcctctctcttgcctgataggaacttctgggaacttttccttgtaccgttttatacttgatgaaattaggaaaagaaatcgctttctccctggtcctcttggggttcttgacctgagtcctctgtgaagcagcttgtccacggctccaccgtagtgctcagatgcacacattgctctcactggtgcaaacctggccgcctgctttcctcatttgccacgtgtggcagggaagcttttgcttagactcatcctgttctcctttgtcttggggtcttccttttcttgggacttgttctctcctaagcctcttccagttcacttcagcccctggatatgttttttcctttttctagaggccagatcctaatacttaatgatcagcttctaacgacatcaatatcagtcaactttttgatttaaagctgtggtttcaaaatctagttataggccaggcgcggtgtctcacacctgtaatctcagcactttgggaggccaaggcgggcggatcacttgaggttagggggtttgagaccagcctggccaacatggcgaaaccctgtctctactaaaaataaaaaaaattagtcaggtgtggtggcacacgcctgtaatcccagctgcttgggaggctgaggcacaagaatctcttgaacccgggaggcagaggttgcagtgagcggaggttgtgccactgcactccagcctgggcggcagagtgggactttgtctcaaaaaaaaaaatctagttatatcagaagcacctggggtacttattaaaaatggagaaacagacttctgtgttctacccaggaaattctggtttggcatttgggagccactgatttaaaagacatcccttagttggttttttgagggtaaaataaaagaatcaccaccttccattcagtcacgcactgtgtgtttgaagccagctgcttctcaagccccgggccaggaactggggcaccagtcccagccttcaccaagtctttcatggtagacaggccaatacagcaccctctgtggaccacatagtgccaagcatgtgacatgtcttggctcgagtaagccttctaacaagcctctgaagtgtgggtcctgttactcccccatttcacagatggtgggggctcagaaggtgagcagttcacagaacttggaagtggtagagctgcgaagcaggaggcagacctgggtgttctggccccagagcctgcacacactccccagaagcagattgctcaggacagaggcgctgagctggctgctggggccaggaaataggaggcatctgtgcagactttgggaagaggcaggctttgaatggagttctggaagaggaatagtggttgggcaggaaaatgaacttggtcctgctcatggctctgctggggcttgctgggcctgtttgagtcctcaccgggacctacactgaaaaaaaaagcagggtctcaccgtgtgcatgatggcggaggtcagggcctcacttctggcccagggccttccatggcccacgctgcgcccagtgggacaggccttgggactgtgtttgctgctgctcgggtggctctcgaggggcaggggcggcctggagccccgtgggtaaaggttctgcagacattgctcggtgtgcgcgtcacctcaaggggccatggtgaagaagagggctgtcaccacagccatgtctgcgtttgaggggccggactcaggagcaagtgtgctggtctcttcagtgtgagctggggccagcttcttcatggtgcagcgctttggtctttctgtccttagactagtggttctggtagggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctag

SEQ ID NO: 12 - DNA, 5886 bp, Homo sapiens
gacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttg

SEQ ID NO: 13 - DNA, 5216 bp, Homo sapiens
ctagttctagatcgcgagccgccgccgccggcgcggaaggacgaggctgaggcgagaaacgaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctgctccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctcc

SEQ ID NO: 14 - DNA, 4408 bp, Homo sapiens
gggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttgatctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaat

SEQ ID NO: 15 - DNA, 5432 bp, Homo sapiens
gcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaaaatgttttcagcctaccagaggcaccaggagctgataactaatccttctcagcagaaagagctgggctccactgaagacatatacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagccgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcggtgggggagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaataaagtgtttagggcagtgggaggagaaaattctccaggtgaatggggaagggtctgttccagcctctccctactcccatcccatttccaccaactggggaactgtgactatctatctcccccgacttctaccagggatgccttcaagccaaggctgttctcaccagctgcctcagatgacaaatgaggctaatggacataatctacagtgtcctttttcacttgcaccttttttataagaatatattgtaatactaaaaaatattaaattcataccatccctaccc

SEQ ID NO: 16 - DNA, 4103 bp, Homo sapiens
ggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcc

SEQ ID NO: 17 - DNA, 6280 bp, Homo sapiens
ggtgaaggacctgggcagcctcaatgggacgtttgtgaatgacatgcgcatcccggaccagaagtacgtcacgctgaagctcaacgatgtcatccgctttggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgatgcccagcgccagggagagccctacccagagcgccccaagggacccgtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggggcaggtgcggctgcagaggcagatcaagcgggacccccaggagctactacataaccagcaggcctttgtcatcgagttcttcgacgaggacacgccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggatgacagcctcagtgacgcagggacatacaccatcgagaccgaggcgcaggacacggaggtggaggaggctcggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaactgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcgggcagtgcccgatacacctccaccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccccgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatc

SEQ ID NO: 18 - DNA, 7453 bp, Homo sapiens
acaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaactaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatggtctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcaactgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagttactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttc

SEQ ID NO: 19 - DNA, 6467 bp, Homo sapiens
aaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttcttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgttt

SEQ ID NO: 20 - DNA, 6299 bp, Homo sapiens
acggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggccaactgctttgatctcaccccagactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgagcggccgtggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgcc

SEQ ID NO: 21 - DNA, 5940 bp, Homo sapiens
cttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagcttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 22 - DNA, 5393 bp, Homo sapiens
cattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagacatccaaccctatcgatgtcgctgctcggcctgggacagtcccacacactttactccaaaaggacccgaggttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaagttaactacagaccattgtttctaataagcagagagatctattttagtagtaaactgaaggtttagttgtgagcttcagattttgtgaactccagatgttgtgcggtgttttttttttttttttaagacaacaactaaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaact

SEQ ID NO: 23 - DNA, 6949 bp, Homo sapiens
aaacaagaagaatgggattgatatttccgcagaagtttggaagttatgtaacagagcaggttgagatcctaccttttaggagcagcctgccccttttgaaggggtaaagggagtgggtgcagtgccctctcttctgttgtagtggcttatccctctaaggcatgacccttggataggggttacctgcctcggaaagtccccacttccttgtgggagtttaaaatagattggcatatgtgagagatggagacaaggtgggaaatcggatcctgtcttaggatttctcatcaggagatgctgatacttggtgtttcagcttgataaattgagaaggtgccatgaaaccaggtcctggaacagaatccctggttgctctgtcttttagctgctctgaccctctgccctgcagagcatgcattttgcatgtgcctggcaggaggccctcctgcttgagccctgctgtatttgtctgtgttgacaacgtgactgccagccattaagcttggtcagtccacagacacactaggaaagcagaggcagctcttggtttctctggaacagagctgcaagaagtctctgggcatctgcatggccaggagcttatgcttaactgttgagtgacctgcagccataagggcattaattctgccttccagaggtgggaatgacttggctttaaacagtgatttgtgtgagaattcttcaaatcccataaggtagaaggcatggtggagtggaggagaaatcttggctcatatctgcctcttccattgaccagctgtgtgaccttgggcctgttacttttaacctacctgaccctccatttcctcatttatcagaagtgtctaactgtacacaagttaaactgtaaggattacatgaggtagtagtcaatcctggtgtttctctgtatcttctcacttctcactggtgttggaaatatgatcttgcgaccctagatggcagccactctggggcagaagagacagtgaccaccttttgaagagctcaaaggagaatattgccccacagggcttagtgggtcccccaggctgaggctggggaggagggccacctttgcctacagcaagtggcatatcattgttctaggggttctcttgacggcagaactttgcctctagctcattttccacagcctagattttccaatcttgccaatccagttgacttctgtcttctcatttccaagccattgttctctctctttcactatctacatggattatccttcattcaaactgctttgtcccggccgggtgcggtggctcatgcctgtagtcctagcactttgggaggccgaggcgggtggatcacgaggtcaggagatcgagaccatcctggctaacatggtgaaaccccgtctctactaaaattaaaaaaattagccgggcgtggtggcaggcgcctgtggtcccggctacttgggaggctgaggcgggagaatggcatgaacccgggaggtggagcttgcagtgggtggagatcgcgccactgcactccagcctgggcgacagagcgagactccgtctgaaaaaaaaaacaaaaaaactgctttgtcctgtaggaatcctgtgcgggttatgtgcacctccctcaatccttaccttgaagctgaggtttcccctcagctctcaagtactcagtttgcactgcaggtagtccctattttaacgaaagttatacggtccagctcagggaatcctgaaaagctgcccttgcttccatggtaatcaaaaggcagttctcatggaataaaagctacctgaagcctgagttgggacctttggctggggaaggtggttgaggacgttctctgattagatgcttggcatgaggtttgctactggaactgctagtgtagaatgtttcagccccctagagttgtccctgtgatgtggctacctcctttctctgggatttctcttaaagtctggggagcccctgcttctcatttcctggaatttatcttcccagtctccctttctggctgaaaatttctagtatcttacagaacagcggtgggatacactggagcacatcatattaccactaagtatgtctaataaatgatgtcctctgatttgacatttcctaaatgtgaagctcctgattttatacaattttgaaattagtaagcttgttagttttgtttgaaattctaggcattggatacacttaacatgagggctacatgtgcatcaacatactctggtttccttccctctgtatcttttttttttttgagatggagtctcactgtctcctaggctggagtgcagtggtgtgatcatggctcactgcagccccaaccttcagggctcaggtgatcctcccgcctcagccacccaagtggctgggaccgcaggtgcatgccaccatgcctggctaacttatttttatatattgtagagacggagtctccctatgttgcctaggctgaccttgagctcttgggctcaggtgatcctcccgccttggcctcccaaagtgttgggattataggcgtgagccactgtgtccagccttttcctctgtatcttgtatccattccccagagcgatactgtgtatccttgaacagacggtttcttgaagtcagagtctatctcctctgtcacttctcccccttcattatctaagactgaggttgtggtttatatgcttagagttgaaagcatggggtccaacgtgttctgtactctgtagttccccagactctccagggaaactacttagctctcaggtggttcttttctgtttttctcagagcaagttatctaataactgaagaggactctgccctttggcctgttcctgactttctaactccttttgctggaggaaggggaggttgaggggggtgccctgtggtgtgaaagccccacttgccctctcctctatactttcttccaatgcagacgggagaaagtatcataaatgtagtgactgtgggtcaggggagctctgagaggccagcacaggaaaccagaaacaaaatgagtcagttcgtaggtggcgatcagaggcaccctgctgagggtgcaaggccacaggtgatgcctcctcagtaggcccaggagcatcaaaacgggaacagtccctttcagccttcaggagcctcccaaatgtcacttagtgatgtcccattcacctgcttaaaggccctgcatcctgccaggtagttggtttgtccatagcatcctgagctctgcttgggtgagccagacaaaaagaatgattcctggccagagtagtgataccagggcccagacagaggcagagagtccggatagaagatcctgtaagctggggtagggagccgaggaggccatggagccaggggaatcattgaagtgagggacaatttctggaggagggaaactgagtaaggaaggcctggccaaggaccaagaaggggacagtatcctgatctatgaaagaagactcaagtggggattgacagagccagattgggtggagtccaagctttgggcaggtgagtgtccaggagatgagggctgagaatgggccttcagagcccagccagaaggggaaagcacaaagctccaccctccttcttcacatccctccatgctgctcaaatcccaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagccgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagagtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccgcttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccg

SEQ ID NO: 24 - DNA, 7150 bp, Homo sapiens
cgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattg

SEQ ID NO: 25 - DNA, 5494 bp, Homo sapiens
ggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagccgttctttacaggatgtcttgcttcatcgtaaacctaaactgggacaggaactgggccggggccagtatggtgtggtatacctgtgtgacaactggggaggacactttccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacagggaagtacgataattccgtggatgtctacgcttttggaattcttttctggtatatctgctcaggctctgtcaagctccctgaggcatttgagaggtgtgctagcaaagaccatctctggaacaatgtgcggaggggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttgggaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggtgacagagtgagactctgtctcaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgtgaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagccccagagtttgtaaaacaggtccccaggtaggtgtataagatgagttgcaaattagccgggcatgctggcacgcaccagtaatcccagctacttgggaggctgaggcaggagaatcacttgaacccgagaggcagaggtcatggtgagccgagatcacgccactgcactccagcctgggcaacagagcgagactctatcaaaaaaaaaaaacaaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtactttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcagatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctc

SEQ ID NO: 26 - DNA, 5406 bp, Homo sapiens
cagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcctatttttttagagacagggtcttgctctgttgcccaggctagagttcagtggtgcaataatggcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctgcttggggtgttttcttttccaacggtgtcttttgcctccttctctccctggccacagggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctagtgagtgtaggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgccgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgctggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaaaaagtaaaaagaaacagttgaaattaattttaataatgtatctcgcccaatatatccaaactgttatttcaacatgcaatttttgaaaaatgtgagatgttttacattctctttttcacacttagtcttcaatatctggtgtgtattttacacttctagcacctctcaattcacaccagccacatttaaaatgctcagtagccgcatgcagcttgtgcagccttacttaggtccagtgtcagcctggggccgtgctggggagctgagctgtgtccatgggggccctggtgagcctccagtgctgtgctgagggtaagggcacccagcgcaagccccagcgcagctgcctgtccagccctgcctcagctccttgcacagaatgagcttgaagtgctcccctctgctcggttctagttctgcctctgacagttttgctctttggttcacaaggcttcctaaactcaggattgctttgtgggtctgttctttgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgtggtgctcacacctgtaatcccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagccgagatcacaccactgcactctagcctgggtgactgagcaagactctgtctcc

SEQ ID NO: 27 - DNA, 5734 bp, Homo sapiens
cttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagtccttggaaaaccagagatattagagcggtgaatcgcgctggtcacgttggacacctgcgcgttaggagattctggagccagagggagagaccccagaaactccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcctttgtcgcctttagcttttagtcctttgaagagaggctctgattgtactttctccacaagcttcagcatggcagtatctctcaccacttgttttggtccaagggcagaaatgagcatcctggaaaccaatcagtacttccgctctgaactggaaaagtgcaaacagaacttccaagacctcacagagaaattcctgacatccaaagctactgcctactccctggccaatcacctgcagaaatatagatacatgatcccttaattcaggctcaggctgaagaactgacccacttacgacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacagagtcttgctctcttacccaagctggagtgcagtgacatgatcttggctgactgcaatctgtgcctcctgggctcaagcaatcttcccacctcagcctcccaagtagctgggactacagaatcaaccccaatgctcactaacaaactgagaagaaaaaaaaagaattacccccaacaacatctgaggaagcacaacagggacagacttgaaggcacctgggcagtcctctggttttggagtagagaaaatcacaatggtaagaaaaatgaagacaggcaaaagccactggctcccaggatgcacctctaacctctacaggcaaatcatagattccattgtccagctgtataatgaaaacagagttctcagagaagaataccggagactcccccgacttgcctgaatcaaatttccagaggctgaggaggaggaaatacaggaagtattggtcctgctgttcagagtggcagaggagaaagaaaatcccagccgtgttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttaccgtctattggatattatggtgaagggcttcagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgagcatgcgcttactctgagaaacacaacactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttacgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaagaagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtatatagaaaaattgctacacatggcctttgcagaaaagagagccttcaaaaacctcttacattccagtagaaaactctctctgcaagtccttaactttgttcactcattccaggaaggtgcttcaacattggatattcacacagagcccagtttttcaagtttgctttcacagtcatcgtttgctgacatgggtgttccacttcctgcaaaaaaatttaacatttaaagatagtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtatttttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcaccctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttacctttcttgggaagtttgtgtagtgttaacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtattttttttaatcagggctctttaatctcattttaatttcctttgtttgaatgaactgtagttattttctgtattcctatattaaccatctaaaccaactgtaatgacacgtacactaataaagaattgaacatttgtatttgt

SEQ ID NO: 28 - DNA, 6151 bp, Homo sapiens
cgacctctgtcaagggcctgtgggtccctgacccctgggtgagcgagggcactgctcccatgggcctgggcactgtgccatcctccagtgggaaacaggaggtccccagggtctgagagaaccatgcagtccaggtgtgaaaggggtcctacaaggtcagctgaccatagagaccttgggaccaccaggaaatcgtgggggccctcagccaggggatggggtcagggctccttgagcctgttccgcccatctagctcccctttaaccccagggaagaagtagctcaggtggagaccctgggtctgcatgggggtcacgtgagctgcctgtagccagcaggggggagggctgggtgctgtcctgaggatgcaggtgcaaatggccatttctgggccacctgtgtgtatcagcatctgcagaggggcctggggtctggctcctggggttggcagccccaggggctctgccatggctgcccaaggtggtgatatttcctgtctgcctgttgggtgtggggcagtgccaccctgtcccatcccacctcatcagcacagaatgaagctggtcctatactcatcacctgtgcacatgaggaaactgaggccccaagaggggagcccaaggtcatattactggggatctgtgggctggcgtctgagcccagcactgtggcttcaagcccacatctgccctaggagggcccaggaggccctgtgatgtcattcccccgtgatgtcattcccccatgacatcattcccctgtgatgtcatacatgtgacgtcattcccgtgctgtcaccacatgatgtcatcccctgtggtatcacctctgtgatgtcaatacctcttttaatgtcatccccatggtgtcattccccccatgatgccatccccccatgatgtcagtcccccatgatgtcaatttcccacaatgtcttcccctgtaatgtcaatactccctttgatgtcatccccgtaatgtcatcccctgtgatgtcattccctcatgatgccagtgtgatgtcatctctgtgatgtcattccgtgatgtcaccccccatgatgcaattcccctgcaatgtcatgcccctgtgatgtcatcccccggtgatgtcatccccccatgtgatgccagtctcccatgatgtcccccctgtgatgtcattcatgtgacatcatcccgtgatatcattcccgtgatgtctcccccatgatgtcattccccatgtgatgtcaatttcccacgatgtcacccctctgacatcatcctctgtgatgtctcgcccatgatgtcatcccccatggcgtcattcttggtcgtggggggttgtggatcccctcctctcccctcccttggggtcttcctggctggtggggagaggtggcctggcctgggtgccacagcagctgctctggaaggtgcccgggctcttgggggccttggcccacgccatcccctggactgtgcggcgccctccagggcccagcttctgttgggtgttgggcacaagtcagaatcaagtgcatctggccagatgctgccagggccaaggatgcagctgcctgtggcctggccttggtgtagagccagagtcttgagcaggggctgaggggacccagatggtggggaggctccggagcatgtgaccagggaccgtcctgctgtggacagacctcctgggctgagtgttggtcgggaccgggccatgcacctagagatgtcctttgaccagtggggagggtctgggggtgagtgtggctgtgtcccttggctactgggccagtgtagtccagggcactctagggactccctgtgttctgacttgaatggagctattggggctgaaggggcaatggccctgtgtctcctcggagcttgcaggtcctcttggaggcccagagagagccagaggagggcagggtcactgctgcctcctcatggtatggaattgactgagcccatgctgggatctggaggccccaaaggaatgaggcctgtggccaggggccggcccaggagctggggtggctttcgggggagaggcccgcagtgctgggaggtaagtggtgatgtgcttggcagcctcagtgctcccttaggagggtctaggaccccacctcgaatcttcctgggctatgcagagccaggaagagaggccaggtggccttggtgggtggcattagatgctccagccctgcctggaactcccttgggggtcgggccacagccaagaagagtgctgttttgcctgtgctaaggccactgtacgtgcagagctggacccagaacctcgtccaaggcccccggcagtctcaccaggaggtgtttagagctggccacgtggagtggcatacctccggggggcgggggggctgtgagagggcagtggtgtgggcccttggtctgtgcctcccacaggacagctgcttcaatagcatctgtgccccctcctgcctgtagtccacccaccactgacccctggacttggctggcggattttcacaccttctcctgggggcaggtctcagcttgtccccaacccagtcagagccagtctcactccctgcctcaggcaactgtgtatgttttaatttttatttatttatgtattcatgagatagagtctcactctgtctcccaggctggagtgtagtggcaccatttcggctcactgcaacctccgcctcccgggttcgagccattctcctgcctcagcctcctgagaagctgagattacaggcgctcgccaccatgcatggctaatttttgtatttttagtagagatggggtttcaccatgttggccaggctggtcatgaactcctaacctcaggtgacctgcctgcctcggccttccaaagtgctgggattacaggcatgagccaccgcctgtaattttaatttttaaccaaactgagaacttgaggattgaatgcaggtaacgggtggtgttcatgtggatgtggattccatgaaagagggctttgtcctcactgtcggttctccacatgtaggtcctttgactcagcaggccttaggcctagtccacaggtgctgagtgaacagccccagcgtctgacagctccttagcttggggtgcacaggcagctgaagcagtaggatggcagctcagacttcccagggccccacgtgtgcagggctggcctcccagcaccaccaggcagggccggcctcccagcgccaccaggcagggccctgtgagtgtcccctccctgacacacaccttgtagagaggctgggcctgggcaggctgctctgctgcaccacatcccattctcaagagggtcccaggtcccaaaggaagcctgtagcccagtggctttctggaggtttgcatggctggcaagcctgggccggctgctggagaggcatcaggacaggagcaactctgctgactgctcccctcagcgagctctaagagtctttgggtgggaggcacatcacatccctgtcactcctggctggccctggaatgcctcagcccacacaccccactccagccagggctgtgggaactgtgtctgctcaggtacaaaaggctttgtttgttcttggacctcttggttctggtctgggcttcccacctcccatgctgtgagcccccacgggctgggaccgcagcttgccatgtgtctctcagtggcaccaagtggacgctcgaggcttatgttgagggagtgagagccaggataggccactgggcgtgctgggagcccacacaggcagggagcccagcgggaggtgccctgctcctgccagccccggttaccccagcaggctcggcacccactcagagcccccatttctgctccccaggcactccctgtgtgcctacctgcccttgtccttgtcctgggccagcttggctcctgcctcccagctctgaggaggcctctgcaggtagccgacctccctggacgagggggcagctgcctcctctcacctgggctcaccctgagccaagtcctctcaacccaggataaatggcctttctgaaggcccagagagcatgcctgccccagtgtgggagctgcatccgctccccacctgacagtgatggccaagagcccagtgttcctggagggctcccaaactctggacctgtaggggggtcagggcagtcgctggtccctaagggaaaagcgtgaccctcggccccaggtggctgaacccgtcactgccagggcgagctgtcacctctgtgagctgataaggccttgcttttaggacctctaatctctgcaagaacccaagctggctctgcctgtttctcctgagcagctcgcagtgttcaccacactccagcacgactcgggacaggcacgtgcgcccctctgcaccagctggagtccctcaggacacctggctggagctgatgggcatgggcgggtgtgtgcgagcatgagcccgcaggtctgtgagcttcgtctccctttccttcttcgcagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacaggtgaggcgccccgccgcctgctgcatgccacacaggtgtgggttggggggctggcagccaggagtctgggggcagcaggctctgggcactgggcactgacagcgccggacagccgggctctggacaagctcccggtggacaggtggacacctcggtcgagaagacaggccggagactgagtggaaggaggggccgaggcagaccccaggtgcacacctgtgtggctctcacagcagccccgcccacctgtcctcgccaccctggcttcaccacccctgcaagtggcatctcactgtggggctccagagcctcaagacagtcacggtctaaccagaaagtgggcaggtctcagggggcctgggagctaggggcctgcccctcggaccctggggcaagaagagcaccctgccgagtgaggtcctacctgcaggcagtcactgccccggccatgggcctctcaaggctggcacgaagccattcagggagagggctccacaacaagctgagggtgcccgactcaaactgtagaaccgggagtggacacccacagacgcccaggctggatgcgtgcgcaggcacactggatctcgtggctctctgggccgctgccaccgcctttgaacgtgtcggggagcaggagccaggccagagtctggcccagaggacagcgagaagcacctgttgatgctggggccactggaggaagctccatccctctactctcagcccgcaccaggcggccagctcagagcaccaggcgtggcgcaagcagggtggtcgtgggcagccagtcccgccctgctgcctggactgtgcccagcgggatgtgggcccgagcaggccagagaggccgagggcctggggtctctgcggcagccacagcccgtggtgagtagcagccttagctgtcctggagataccggggcctcgtggagtctaggcaggctggggcactgtggctgtggccgtggccaggtgagaagccccattcgcgcaggaaagactggccacctgggaacccacgcctccacggagggacttgccggccacaggctgtgggctgcccaagaggactgtgcaggcagggctgcctgctgattggcagctccggatcaggcccggtgcctgcagacctggtgctcccctcgggcagggctgggtgccgcagccgcctgctggcttttctggcagctcctctgtatcagaaccaataaagtgcacttgttctcgg

SEQ ID NO: 29 - DNA, 5770 bp, Homo sapiens
gtgagcccgggaggcggacttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtatataaaattctgtctttcatttccaaccatttttcaagagaagctgctactatcttgagacttcgtattatcatgggagtactgtaagttcagtctcagggaatgctaaattagagtaataagttttatatccttcattctgggagaggaaatcaacataaggtgttgactaattgattatcctggaacattttgaatatcggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctaccgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcggctcgctgcaacctccgcctcccgggctcaggggatcctctcgcctcagctcccgagcggctgggactgcaggtgtgcgccgccgtgcccggctaatttttgaatttttttgtggggatggggttttgccgtgttgcccgggctggtctggagctgctgggctcaagcaatccacctggctgggcctcccaaagcgatgggattgcaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgtggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 30 - DNA, 5113 bp, Homo sapiens
gctggcggagagcggcctgcgggcgatcgggccgagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcggctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgggtgagcatgctgccatccggcgtggggccagagtacgcagagcgccccgaggtggctcgccgggacagcgcccccaccgagagccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccggccccccagctccctcgccactgccggccacaccactcagcgccaaggaggacgccagcaaagaagacgtcatcttcttctaaaagggccgtgactcaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggttgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatg

SEQ ID NO: 31 - DNA, 5117 bp, Homo sapiens
gctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttt

SEQ ID NO: 32 - DNA, 5471 bp, Homo sapiens
gaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtaccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtggtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtct

SEQ ID NO: 33 - DNA, 4160 bp, Homo sapiens
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatacacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctccttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccagggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcag

SEQ ID NO: 34 - DNA, 5887 bp, Homo sapiens
ggacgagtcgagcctcctgcggcgccgcgggctccagaaggagctgagcctgccacgccgaggacgtggctgccgcagcgggaaccgcaagagcttggtggtaggaacgccctccccgaccctctcccggcccctgtcgccattgtcggtcccaacggcaggcagcagccccttggatagtcctcggaatttctcggctgcctctgccctaaatttcccctttgcccggagggcagacggcagaagatggtccctcgcgtctctcccatcttccggctatggaaccaacacacccagctccaccctctcgtcaagctcatcctcccgggaacgtctccaccagcttcccttccagccgacgccggacgagctgcacttcctgtccaagcacttccgcagctcagagaatgtgcttgatgaggaaggcggccggtcaccccgcctccgaccccgctctcgcagtctcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccggccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcagggggctggatggggcaagaatgggggacaagggtggctttgtaaatagcagcaaatccctgcaactaatttattactttttttttcttttttttttttttttttgagacagagtctcactctgttgccccggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttac

SEQ ID NO: 35 - DNA, 5688 bp, Homo sapiens
taggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagttgactctgccagaacaaacgttcatgggctactggacaattggtcaggcaagaagtgggatgcaaaaactcttgtgtccagtggaaactcatcatatagacataaagggtccagcacttataaatatacaggagtatccaatagaaagacatgaagaaagatccctaaactttactgaagaatgtgcctcatggagaataccattggatgaaattaatataatctgtgacattgctacatcacatgaaaatgagcaaaatactctctatgtagttacatgcaatcccgcttccctgtactttatgaatatgactgggaaaagtggcttctttgtggacttttttgatatcttcccaagaacagccaatggcgtttggcacccttttgtgacagtggcaccgctgggaagtcctctcaaaggtcaagtggttctccatgagcagcagagtaatgttatcctgttgttagatactactggccgggcccttcatcgtctcatcctcccttccgagaagtttacatctaagaaacctttctggtggaacaaagaagaagctgaaacttataaaatgtgtaaagaattttcacacaaaaactggctggtgttctacaaagaaaaagggaacagcctgactgtgctggatgttctagaagggcgaactcacaccatctcacttcccatcaacctcaagacagttttccttgtagcagaggacaaatggcttctggtggagagcaaaacaaatcagaaatatcttttaactaagcctgcacacatcgaatctgagggtagtggggtttgccagttgtatgtgctgaaagaggagccgcccagcacagggtttggagttacacaagaaacagagttcagcatacctcataaaatttccagtgatcaactatcatctgaacatctaagttcagctgtggaacaaaagattgcctctcccaacagaattctctcagatgagaaaaattatgctacaatagttgttggttttccagatctcatgtcacccagtgaagtttattcttggaagagaccatcatctttgcataaacgaagtggcactgatacatcattctatagaggaaagaagaaaagggggactccaaaacaaagcaattgtgtgactcttttagatacgaatcaggtagtgaggattttacccccaggagaagtccctctaaaagatatctacccaaaagatgttactcctccacaaacatctggttatatagaagtcactgatcttcaatcaaagaaactccgatatatccctattcccagatcagaatctctctcgccgtataccacatggctgtcgaccatttcagacacagatgcactgctggctgagtgggacaaaagcggtgttgttactgttgatatgggaggtcacatcaggctttgggaaactggacttgaacgtctgcagcgatcactcatggaatggagaaacatgattggacaagatgacagaaatatgcagataacaatcaacagagacagtggtgaagatgtaagctcccccaaacacgggaaggaggacccagacaacatgcctcacgtgggcggcaacacttgggctggcggaacagggggaagagacacggcaggcctgggtggcaaaggaggcccttaccggctggatgcaggccatacggtgtaccaggtctctcaggctgagaaagatgcagttcccgaagaggtcaagagagctgctagagagatgggccagagagcattccagcagaggctaaaggagatccaaatgagtgaatacgatgctgcaacctatgaaaggttttcaggtgctgttcggcgacaggtgcactccctccgaatcatcctggataatttacaggctaaaggtaaagaaagacaatggctaagacatcaagctactggagaattagatgatgccaagatcattgatgggctgactggagaaaaagccatctacaaacgtcggggtgagctggagccacaacttggcagcccacaacagaaacccaagcgtctgcgcctggtggtagatgtgtctggtagcatgtaccgtttcaacaggatggatggccggcttgagcgcacaatggaggctgtgtgtatggtcatggaagccttcgagaactatgaggagaagttccagtatgacatcgttggacactctggagatggctacaacattggtctggttccaatgaacaaaatccccaaggacaataagcaaagactagaaattctgaagacaatgcatgcccactctcagttctgcatgagtggggaccacacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaagtaaatgcttttgccatttttattggctctttaggtgatcaagcaaccaggcttcagagaactttaccagctggtcggtctttcgttgccatggataccaaggatatccctcagattttacaacagatcttcacctccaccatgttgtcgagtgtctaagaagtgcccttcatcaccctgatgacaccaggatttgaaataagacaggaataaagagtattctgaaaaaaagaagatatggatgaagtgaacccatgcagtgactggatgattccggcattcctgggtcttcctacacttgctccgtaatgagaattcagagaagcagccagaaggagacttaaacatggaaagatactccactgatgagtttagaagtgattagggcaagctagttgacctgcactttatcaaaggttggggttaaaggaaggtggttttgagaactatgtgtttggtctatttccaaaaacctgagggggagaaaatactttgcttttgccttaacacatcatctggtcacgttagaaaagtgaccccatcaaactgagcctttgatgtcacattctgacacaagatgcaagtctgtgcaaaacccaccaaaatgctcctatccaacaattatttttattttctccctgctctgtattgaccagaaaacaatgattttataatatttaacccaccaaaaagtccctccaacagcaatatcttatgaaaggctggctgttctcaataatttcattttcttggccaaagccaaaaggaatcaaaaaatccttggagtgcttgcctttccacgtgacttttaaaaggctcttaaagagcaaatgtcctcttctccttgctgctagagtgggaggagaaagatgtcttgccttaaaagtttactgtttcttctgttcttctagcatctctcaaaaaattcacagtactccattttggggtccaaactgtaatgctcaaaataataaatgcttacacgaaaattatttattgagaatattcatataaaaattacctaaagcaaagtaaaaaaagtaaaatcaaggtggtatatttgaagtgaatggtgattggaaatttttagctgtaacaaaaagaaagaaaacaactttttttaaagcctcattctcttttctttcaaaatgtaccttattcccacacactcttgggctgacctttattttatcaataagctcaatattactttgtttaaaataagatgcttcagcaaaagtcattctctctttaaccatataatttaaaaactcctcttcacgattgatagcaaaatcagaaacgttagggcaccagtgagttgaaaaaactggtcttaagttggaaaaactattattaataatattatcctatccatccatatctattgaaattgtacaggtccataatttcattttaattaattataggaaagaagaaaagataatacccatttgttctatcacccctctccctatcattaactatcaaataaataaataaaagcaatctgatttcc

SEQ ID NO: 36 - DNA, 5147 bp, Homo sapiens
tgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttaccttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacac

SEQ ID NO: 37 - DNA, 4747 bp, Homo sapiens
tgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaagtaagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacaatcatgctttagcatggctatggagctaattatcaagcttaaagggtaactttgggaggactcctcccttcactcctagtctcccttggaagagcagtccaggctcagggaagggaacggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactctgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacct

SEQ ID NO: 38 - DNA, 5100 bp, Homo sapiens
cgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggattagggacacttgtggaggccgggctcacccctgagcagataaagagactctccctgaggtgctttcagcgtaagcttttggcagccacccaactcagttctcgcatcttctgctcctaccttctcctctgtcttctttgaatttggatattccttccctggtccaagctcctatcttcggtcaaatgctgtttttactgcttcctaaggatagattatcaagaaatttaacagctcggccagctcagtgaaacactgaagctaatgggatgttgggtaagaaggttctgtgctgtctcattgaaaaccgagccagtcaaccacaaggctggcagggtgtgatccttgtaacgtcttgtgtctgttacctcacggatgtcggtaaggagtttccacagagccagctgtgtaccacagagactgagagtggtgagtggactttgtgagccaattatgtgtcggaaggacttggagtctgcccttcttcctgtatgtcatcatcagcccacaaatgcattcagtggcagtgacccagcaccatcaccatcacccactgctcagtctgtcttaggattccttatctttttctccatcatcatagagactgaaatttcaggggtgtttttgtacagtgtatttttttgtgggggggtgatacattggggttttttgtttgcatagagtgggaacggtgtgcaatgtgctcttaccacagaacttaaagtatgaataggctccattcttccgcaccatgggatccataagaagtgctcactttgcgaggtactctgagattagcgttccccatttgtttgacctacagacgttaagtgggtgacttgtgttacacacggggagtaaattcagagatggcacctgtagtctttgcagtctgttgatacttctaaataactaactggatgactttttggggattgaccagcagatgccatctcttgccctcttgattcacctgcttgccttaatttgtccctaaattcaactaaacttcaataagaggggttgtcaaggccatggggcgcacttggaagcactgcctgggctggagcgttggaggcattggcaggcaggtgggaaggagctctcactgcagtgttcacaggcagggaggctgtgtgtggatgtgttagaattgtgtgctgttgcctctcaaaatatccactagaaacaggtgtaaccaggaaaatacaggtctctgctcactgttattaacagactgtcatttcctgacattgggtcatgtggctttactctaggaggctggttctctatttttgtcttagttcaattttctgcatcctcaaatgccaaccccagtatgtggctgggtaggtagaactgtgctgcctgcctgccatgggggctgctctccctccttacccccacgcccacagcccccttggttctgtggtgggcacaggatgtgtttgggtgtgagtaaagtcaaactctgaatgtataatctcttggtagtaatatctgagtggtgttgctactcctgctttttaaaaagacttttcttgccatctataaaaagcttttttctttttcccagcattgctcctgtgctgccacgcttgccctttttccttaccttcctttcagttttctatcaacaactcctctaaacttcagtttaaaataaaaaacagcccaaaaaggctctttgccaccagggggcgtggtaggacacgttgccagtggtctggataggggagcagaaattttgaattttaaaaattagccaccaaggccaggtgcagtggctcacacctgtaatcccagcactttgggaagctgaggcagggggattgcttgagtccaggagttcaagaccagtctgggcaacatagtgagatcccatctctcaaaaaaataataatctagaaaataaagattagccacccagttttctttctccagatgctaaagttgattcctgtttgataacagtattccagaaatgaggggaataacatatctgataggcccaagtcatctctggatagtacagtgtctggatagtacagattctgtgctcctgggacatgctttgtttattcctgccaggccagggattcagcagccctattccccaacccccgttactgtctctgtgggctagccaggctgtccgttatgtaagcacaacaggggcaaggtggggaaaccgtgtgtggaaaaggagtggagtggtggcgggtggccaaggtagactaggaagagtgggtacccagagaccacttgttcagaagttaactcctcttcccatctggcgtgagctactccattgaatggtgccaacaacagtaaagtgaaggagataatgttagattattttcaggggtgattctccaagatgacagcagatcttaaaaccaaagagctgggtcctggaagaagggatcttggattattaacttctgatggaaggaccagagtgggagagagaagagttggggacctagaacatcaggaggaccctgggtctttggggatgaggcttcaccatcagctggaagaatccatgcttcacacacatgcctctgccattagtggtactgggatgtttagggtgacatccttgaggggagagccactgaaaagagggacattcacattttgctgtattcttgcagctgtccgtgtcttaataattcaagcgttcaataggtgtttgagggccaggcactgctcttgaggtgctggagataacggtgacaagcccaggtccctgacaagctccacaagcttaatggacagtgaatgtgcggctgttgcggctgttcacagggccgctggtgagggcaggtagaagaaagtgcagaccttcttaaatgcaggtgtaacggatctacatgaaagagcataattaacaccaatgtatacttaaggtagtaacagcttcttcataaagtagcaaaactaaggatctgtgggaaggttgctggtgcaaatgctttataagcttactagagactgagccttggatttaggactttagacgagtataggatggaacaaaatttttgcagtaaatgtaaaaaatgctgtgtaggaggaaggcgtataaggatgccccagctgtaggttctttagattgtctgtagtatttccacgagtaagttgtttttgatgtgtgtactggtattgctggtagatttgaagtggagtctggcggcttcttccacactcccctcccactagcttgtgtcaagatgtgacatcctatgcagcaaaactaggtgagcttgcacccccaggcggtggctctcaactttgtctcattgttcagaaatttcggccaggcgccgtagctcacccctgtaatcccagcactttgggaggccatggcaggtggatcacttgaggtcaggagttcaagaccagcctggccaacacggtgaaaccccgtctctactaaaaatacaaaaattagccaggtgtggtggcacatgcctgtagtcccagctacttggtcaactcaggcaggagaatcacttgaacccaggaggcagaggttgcagtgagctgagatcaagccactccagcctgggtgacagaccgagactctgtctttaaaaaaaaagaaatgtcatctaagccccagtgaacctcctgggaggagagctagccctggccagctgtctccaaagtgactggatgctacagaagaactgggactgtcttctgcacactcgtgcctcctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttgg

SEQ ID NO: 39 - DNA, 4860 bp, Homo sapiens
ctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagag

SEQ ID NO: 40 - DNA, 5282 bp, Homo sapiens
gtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgctttttgcgtttctctccggtccccaggaaacatcctagaagacaaggatttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagag

SEQ ID NO: 41 - DNA, 2985 bp, Homo sapiens
cggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgtttttttttttatattttgagaataaaacttcatataaaattg

SEQ ID NO: 42 - DNA, 5507 bp, Homo sapiens
ggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtggtctcagctgcttgggaggctgaggcaggagaatcgcttgaacctgggaggcggaggttacagtgggccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttgtttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttgctgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 43 - DNA, 680 bp, Homo sapiens
cttcaggcatcgcagccatcgtgttgtcacgctacctccctagcacccccctgcgctggacagtgtttagctcgagcgtggcctgtgctctcctttctctgcacctgtgccctcggcctcttggcctccatcgccatgacctttgccacccagggcaaggcactgctggctgcctgcacttttgggagctctgaactactggccctcgcaccttactgtcccttcgaccccacacgcatttatagctccagcctgtgcctctggggcatcgccctaaggtgctctgcgtgggcggagaacgggtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgcagagatgatgtcctgcccaggcccgatggccaacttaggaccctgcaagcaactctggtctgtgaccaggcaggcttcctgggagctggcctgagagggctcaaatggaccctcgggggaccaagtggggcttttcaacccttctcccccaccacccactggactgaatagactttatctgaatattaaaaaaaaaaaaaaaaaaaaaaaaaaaaaaaaaaaaa

SEQ ID NO: 44 - DNA, 6718 bp, Homo sapiens
gcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagcccagcggatttctgggggaggccctggcagcggctcctgtctctctgacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtctccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgt

SEQ ID NO: 45 - DNA, 6754 bp, Homo sapiens
ccgggctgcgcggcgaggctgagccgggcccgggcgccggggccgggggcggctggcgcgggcaggaagcgcctcgcggacccgggcccgccccccgcctcccgccgcctccgggctcccggctcccggccgcgcctcgccccatgcactcgccgcgccgcgcagcccgcgcacgcccggatggctcctcgcgccgcgggcggcgcaccccttagcgcccgggccgccgccgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggtaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccgtttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctacgggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcatgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccactctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggtagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgc

SEQ ID NO: 46 - DNA, 4915 bp, Homo sapiens
gcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggagtcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgtcgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgcgcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtg

SEQ ID NO: 47 - DNA, 5127 bp, Homo sapiens
cgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgcttttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccccgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtctggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataact

SEQ ID NO: 48 - DNA, 5177 bp, Homo sapiens
gcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagatgatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 49 - DNA, 3985 bp, Homo sapiens
gggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccgacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggtgagtaaagccaactgggcagcggcaggagggtgagggcgcctgggagctgatgggttaagccacacctatgggaggctttccaggacttggggtggcaacgggtcctgggatacgtaggaggtggggatgggggaggggaggggtagagcacacccagggctggaaagccctggaactgcttggctcagatcagctgctcctggtcagctgttcccacctttctacgccccttcttgccaggcttctcctctctcctgccactggaccatgtttgtctctcttgaacagccctgtttctaccagttcctttcctccccacttcaccaacactgccttcctccagcctgtccctcctccttcctgccctctgcccagcttgcctctgcccatctcagcaagttccatgtcagcctcggcagaagcctctttctttcctcttccccataagagacatcccaccttctatcccaaatcccagcattcccttcaggtgccacgctgtgccccacccctagctgacccccaccttcttgccgccaagacagccctaaccaaggcccagaaagggtagggcagaacctgggggcccagctctttgtgtactggtgtccaggctctgccaggggagaggaaggtggtacccccttctctccccagccccatgtggagtcattcctctgcaggcaactaggagaacctaaccaggccaggcgggtgcccttggacagcttggaaggcgtttgcccttaccctgggcaggggtagagagacaaggaacaataaaagtgctacagctc

SEQ ID NO: 50 - DNA, 4103 bp, Homo sapiens
tgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagcacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgccagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttg

SEQ ID NO: 51 - DNA, 4611 bp, Homo sapiens
ggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 52 - DNA, 4153 bp, Homo sapiens
aagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgcttttttaaagaacaacattgccagagtatgcttgttctaacaatatagatatataaaccttaaaaataataaaatatctcacccaagacttaaaggaagaattctctgaagggataaagattact

SEQ ID NO: 53 - DNA, 4157 bp, Homo sapiens
ctccagcctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtggctgggtgtcccgctgggcgccttccacgccagcctcctgcactgtctgctgccacagctgagcagcccgcgcctggcggtgcgcaagcgggcggtcggagcgcttggccacctggcgaccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacggcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggagttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggcccccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcgctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagtt

SEQ ID NO: 54 - DNA, 3767 bp, Homo sapiens
gctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacagggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtccggctgcagggaaggggcaagaaggcgggcaggccttcactgcagcactgagcctcaaatccgctctggagcatgaggctggatgcagtggtggtgaggccgccccgctccatcccgaggcagccaggctttgttttgcgctctcctgtcacaaatgctgcactattggttcttaagttttttatctccagatcctaatttatgcctatgcaaaaaataaatgacgcccaagagctg

SEQ ID NO: 55 - DNA, 4263 bp, Homo sapiens
gggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcagccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcgcaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttg

SEQ ID NO: 56 - DNA, 3811 bp, Homo sapiens
cacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgttctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaatttttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtataattgtgaaatgttctatacactatcaaatatataaagctttctatattgaatgtacattatacagatcattcatatgtgtacataaaattttaaaaataaagggaattgactgctttgtt

SEQ ID NO: 57 - DNA, 3859 bp, Homo sapiens
cgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccattttaaaatacagaatcccattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgtttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgttcatactgctactttcccatgtttcctatatgcctcccctatattggagaggataactcgcgtttacatatgtgatagttatgcttaatactaattcacagagttggctcgatcattttgagattctagttgctttatctcaaagctttcactgaagggctgtaactgaaaattattaaatgttagtctttagtcaaatctctgcattgtttcatgcagaaaataaagatacaattaaggctg

SEQ ID NO: 58 - DNA, 3900 bp, Homo sapiens
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtact

SEQ ID NO: 59 - DNA, 5020 bp, Homo sapiens
catggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcctggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtgggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgacatc

SEQ ID NO: 60 - DNA, 5066 bp, Homo sapiens
aaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgtcatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgtt

SEQ ID NO: 61 - DNA, 865 bp, Homo sapiens
gactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctgctaccagtctgacattcccagcagcctcctgacttcagagaagtctaccgtctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatggcaccacaggcctgcccttcatgcccagccccatgggacacccggtggtctttcccaaac

SEQ ID NO: 62 - DNA, 910 bp, Homo sapiens
gagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatgggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacaca

SEQ ID NO: 63 - DNA, 3911 bp, Homo sapiens
aacttacatgcttgctgtaactttggatgaatggaaaaagaaactggaatctcccaacagagaaattattattttacacaatccaaagcttatggtgcattaccagccagttgcagggtctgatgattggggttcaacacccatggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaagggttcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaaaatg

SEQ ID NO: 64 - DNA, 4130 bp, Homo sapiens
ggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatatttt

SEQ ID NO: 65 - DNA, 3900 bp, Homo sapiens
agaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccagctagtgtggactccatccccctggagtgggatcacgactatgacctcagtcgggacctggagtctgcaatgtccagagctctgccctctgaggatgaagaaggtcaggatgacaaagatttctacctccggggagctgttgccttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagt

SEQ ID NO: 66 - DNA, 4204 bp, Homo sapiens
cagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccaaaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagtt

SEQ ID NO: 67 - DNA, 4047 bp, Homo sapiens
gcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagctacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagtcgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcgacgactgtaagggcaagaggcacctcgacgcgcaccccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaggg

SEQ ID NO: 68 - DNA, 5804 bp, Homo sapiens
gcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacggccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatgacatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttggaaaaaatataatttctttctttacttatattcacctcatggtaggttatattgaaggctgacatggagaatgtttacttttctatttggcatagctaactacactttgatactaactccagttttactattattattttggttggaaaaaaaattcactttttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtag

SEQ ID NO: 69 - DNA, 5333 bp, Homo sapiens
aaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactactaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctgttataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctct

SEQ ID NO: 70 - DNA, 4638 bp, Homo sapiens
cgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattacggagctgattttctagtctgtggatcagctatgcctttggacacttctcttttccattgtgccttttgaatgttgtcttctcactcagcatcagcacttcgatctaaatgcagactagggagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgac

SEQ ID NO: 71 - DNA, 4868 bp, Homo sapiens
gggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacggggtctgctctgtcacctaggctggagtgcagtggcttaatcatggctcattgcagtctccatctcctgggctcgagtgatcctcctgtctcacctcccgagtagctgagactacagtacaggcgcatgccaccacacctggctaatagaaattttttttttagagattttgctcaggctggtctcaaactcctgagctcaagggatcctcccgccttggcctccctaagtgctgggattgcaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattcatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtccaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtggtcccggcactttgggaggccgaggcgggcagatcacgaggtcaggagatcgagaccatcctggctaacacagtgaaaccccgtctctactaaaagaatacaaaaaattagccgggcgttgtggcgggcgcctgtagtcccagctactcgggaggctgaggcaggggaatggcatgagcctgggaggcggagcttgcagtgagccgagatcccgccactgtactccagcctgggcaacagaacgagactccgtctc

SEQ ID NO: 72 - DNA, 3896 bp, Homo sapiens
gccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgcc

SEQ ID NO: 73 - DNA, 4199 bp, Homo sapiens
gtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatc

SEQ ID NO: 74 - DNA, 4436 bp, Homo sapiens
cccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgatttctcttgcactttgttttgttttgatgtttgggaactcaatgttattaacttcttattatgcttcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatataaaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagttttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagaaatg

SEQ ID NO: 75 - DNA, 4487 bp, Homo sapiens
cacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgccatgagaagccgatccattggtgaatgtgctctgccatcggcctatatacgcagtgctaaaagtgctcctgttctgatccatacttccaaacccttcttgcctgatattgttctcactcccctttctgatgagctttcagatattgatgatgctcaaatacttccccgctcaactagagtcagacatttttcacaaagtgaagaaactgcaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctaggcaatatttcaaaattagatatttaccttttttcttttagggcgtcagtgtcaggagatcataaataaggcatcttacatttgattatatatgattattgtaaatattttggacttttctaagtcctttggaaatttgttaatgtaacttttttcttgttcttaaagatatttgttgtctgagttttattcattttattatagttgattagagtcctcaaattagttattgcattattttcaagtattgtattatcatttattgatattggtagtgtttcctaaaacaggaaatacataatttggcatccttattcttagttttatacctaaagaacctagtaactcacaggagaacgtagtaacattatcacttgttaatcaagctttcagtgaaacagtttatcaaaccattttttttattttgattcagcaaatttgtcaactaaatttaatttaaaagtagaggtccaaatgaatattttcaagtaaatgttaaaaagtgacttgggaaacctaagtaactgccaagttttttttaaagttatttttgctagattttgtataatgtaacaaacatcagacaaatatgcacatttatggcatatgcaaatatgccataaattggtcaaagacacagttaatgagatatttacaatgaatgaaaagctagttttcattgataaggtagcacatttattctctgacgaaaggaagaaatttaaaactatataacttctaaacttcttttaagaaacccgtttattttaaaactaactgtagaggtgaggtttcaccatgttgcccaggctggtcttgggcttctgggctcaggtgacccgcctgcctcggcctcccaagattgcgggtgtgagccaccacacccggcccaagggacccattcgttaacttgcaattgccttgtaattatatagccctaattttctggtttgtggattatttctgaccttttctttttctcctttgatctgcagttgtttatttgtttacagttatttccccaacatttggaaaaaaacttcagttatagaagtgtttcaaggctagtaaaatgaatgcacataaaccctttatataaattcatcaattaatattttgccactttgtctatatttacacacagcacatatatgcacaaaatagcctgcccttcccacatgtctccctaaccttttatttttgctgaggcatgtaagaggaaattgcaaatatcagatccttcagacctaaacatgtcagtggatatgtcctaataagtgtatgttttctgcgtaaccacaatataatggccatattcatgatatttaacatagatacattgctgttattttagtctatagtcgtaagtcctcaattgtcccaataatgccctttatagctaccccacaccgtcagcaatccaataaagaatttaatcaggctgggcaccgtggctcacgcctgtcatcccagcactttgggaggcaaaggcaggtggatcacctgaggtcaggagttcgagaccagtctggtcaacatggtgaaaccctgtctctactaaaaatacaaaaattagctgatcatggtggcacacgcctgtcatcccagctactcggtaggctgaggcaggaaaattacttaaacctgggatgtggaggttgcagtgaactgaggtcgtgctgccactgtactccaacctgggtaacagagtgagactgtctc

SEQ ID NO: 76 - DNA, 3882 bp, Homo sapiens
ggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagt

SEQ ID NO: 77 - DNA, 4401 bp, Homo sapiens
gggctggctgcggcggtctcgctcggctgtccgttccttgctggagaatttggccacaaagagctgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggccc

SEQ ID NO: 78 - DNA, 4091 bp, Homo sapiens
gtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgaggggaaaaaaatgtaaatgttctgaaaattcactgctgcctttgtggaaactgtttcagcaaaggttcttgtatagagggaatagggaatttcaaaataaaaaattaagtatg

SEQ ID NO: 79 - DNA, 3605 bp, Homo sapiens
gggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatgatccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgggtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctctcagcatcccttccccttctctcctcctctgcctcacttctttagtaatcccaaccctataaaaatgagcctaatgggtggattgaatatacattgagcccaaagtcaagtttggggaaaaggcagactaaggcctcctttctctgacctcccaggaagaaaatagcttctcctacagtgattcatgtcccaggtccaggaaatccaatcttggtgaaggcagccactctcttgcttgtccccaaatcacctaaccctcatccagggctattttggtgggcagggactgcctcctcccggaattcctaagatctgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaaatctgtgcaaacagtgatggaaggctgttgtcttggtgtatcccttgcctcatagtcaatatatttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgt

SEQ ID NO: 80 - DNA, 6189 bp, Homo sapiens
ggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcgtgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacagcatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacagggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccagggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatg

SEQ ID NO: 81 - DNA, 5650 bp, Homo sapiens
ggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactctttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagcc

SEQ ID NO: 82 - DNA, 5537 bp, Homo sapiens
cggacgcgtggggttttattttacaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatcctgttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccccgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctg

SEQ ID NO: 83 - DNA, 5011 bp, Homo sapiens
aacaaaaccggtatgtcaactatagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggcagaagcaaaggcagcctcaggccacagatctggactccagtgggacacatggcagtgagatgcttccagccacagaagtgactgtgtcaggagggttttctgttgaagaaaccagctgtggagacacagggagatctggtggtgaggccctggctgttgcaaatgattctaccagcacaccacaaaatgctaatggactttggaaattgaaatctacaactcccggtggtgctttgcctgagtgttttggcaccacagacactactttttcttcagcattttgcagaaaacatggagagacacaggatacctcccaaagtagcctgcctggtaccttacattgttacacaggcattcgagaggggggagacgacactgaggtagagagtgaggcatttagctgcagtgaggggagcgaacagcaagatgctcctgatgactcacagaaaaatttaggagacacagatgctgctgtagccgaggtgagaccttccttagaggtaggttatttgacgtcagctctgcaagattttaacataagtactttttctgagctggatagactttccacatcagaggttgtgatgtttcttgagagctgtcagttaggggattatagttcaggggactctgtttctgaatgttctagtaaaggaaccctaagtaaagaaatgaacaaagaattaaaggcaagtgaaataggagaaaaatacagaaagcaaccctgtgaggaagaaacacttggaacctgtgaagagtggattgaatcagaggaagatgattattcgttaaaaaatacaagtcagctcactcagtgttctttggaaactctgtctgaggttctgaccaagattaggcaagaacttcaaacaaattctgaagattgcaatggtaaagatactggcagtttattgctcttaaatgtaaataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggatctggacgcatgataacatcataagtaaggagctgtggcctgtgatggataaatggataaaatacagaaaaggacatgcaaacattgcgtatactcctgatattattatagcctcaatactgaggctgattggtcgtttaggccaattgggtttgaaagaaggatttccatctgctgtgaaaaatattagttcggttattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatgg

SEQ ID NO: 84 - DNA, 4413 bp, Homo sapiens
aacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccacc

SEQ ID NO: 85 - DNA, 4343 bp, Homo sapiens
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagcccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttctttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtc

SEQ ID NO: 86 - DNA, 4410 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctcttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtggtaggtttttctttatttttacaacatgataaattttcagattaaatctgaaatatgtatttacatagatagctataaaagccataaaaattgatgaagttacacaaaaattttttgaaaactatggcaaaatcactttgctgccctccagtggctctctttttctaagtcctttgataagaaacaaaagtacaaggttaagaaaccctggcatagagtattttaaaaagtgttttggaaagtatttgtcaatgcttagagatagaaatggctgtgttatatataggaagtaaattttctcaactatacccagatatgtgtttgaaaagtaaaaccctccctactttttggctatagtgtattcctggaaactgcataggaaagcaaacatgggaagatgattgttttattgttttctacttttaaatggtatgggaaccttgagatagcaaaatgctgcctagtactatgccaaatacagtcaacttttgatgctttctgaggaaaagaaaactggtaaactgatggatggatgagttgaagttaaatatagtatagtaatttgtatagcctcaggtgagcagcttgccaaaacaaacaaacaaacaaacaaacaggggtgagggatttggaaatatagtaacaacaatgataagagactgtgggaagaaatgagagttgctgccatcagatccaatgcagtggggctcagatttaacactgataatgaggttcaaagcttaaggagaaaagactataaatgtgagaagagaagccactaacgattcacagtaagtggttttagtagattcgctagctatacagttataaaatcttaaggttttttcttaagcattccctgagaaaaatcttaagattttagacacttttctagtcaattatttacaataggtttattgattaattaactttgttttagttcacttcctattgtcaccttctatagtttctggtaatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgcctgtaatcccagctgcttgggaggctgaggcagagaattgcttgaaccggggaggcagaggttgcagtgagccgagattgcaccactgtacttcagacaagactctgtctc

SEQ ID NO: 87 - DNA, 3958 bp, Homo sapiens
cggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctcc

SEQ ID NO: 88 - DNA, 4783 bp, Homo sapiens
cgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcctgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggaggcgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccatctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatccttgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaaataacttattccttttttgcatatttgtatagccttctagaatcagaaataacctttttgcatattcttttattgttctgacttttcaagacctattatttttttacataggtcaataaacaaaaggtgtgctactg

SEQ ID NO: 89 - DNA, 4131 bp, Homo sapiens
cttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcatgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataacgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctccagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgatt

SEQ ID NO: 90 - DNA, 1640 bp, Homo sapiens
aatgccacctgcttgaaggctatatgtgacaagtcactagaggttcacctgcaggttgacgccatgtacacaaatgtcaaagtaactaatatttgctctgatgggacactctactgccaggtgccttgtaagggtctgaacaagctcagtgaccttctacgtaagatagaggactacttccattgcaagcacatgacctctgagtgctttgtttcattacccttctgtgggaaaatctgcctcttccattgcaaaggaaaatggttacgagtagagatcacaaatgttcacagcagccgggctcttgatgttcagttcctggactctggcactgtgacatctgtaaaagtgtcagagctcagggaaattccacctcggtttctacaagaaatgattgcaataccacctcaggccattaagtgctgtttagcagatcttccacaatctattggcatgtggacaccagatgcagtgctgtggttaagagattctgttttgaattgctcggactgtagcattaaggttacaaaagtggatgaaaccagagggatcgcacatgtttatttatttacccctaagaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggagtgaagtgcaaccagtggtctgaggaggcttctatggtgtttcgaaatcatgtggagaagaaacctctggtggcactggtgcagacagtcattgaaaatgctaacccttgggaccggaaagtagtggtctacttagtggacacatcgttgccagacaccgatacctggattcatgattttatgtcagagtatctgatagagctttcaaaagttaattaatgactgcctctgaaaccttgacaactaattcagattttttagcaataacaaaatgtagtaggcttaaaaaaaatcttaactctgctacatggctctgactgctgtgggggattgaaaagaatatgcttatgtttgatgaaagatatttaacaagttttgttttaacagagttgacttttcaaagaaaattgtacttgaattattactataatattagaataaaaatgtttatc

SEQ ID NO: 91 - DNA, 3082 bp, Homo sapiens
cgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggagtctggtgagggcggccggccaagaggaggagaggcatccctgcagggctgcaggtggggcgccaatggcctcgccaggggcatatggatgtggagccaccccttcttgctggggaaagaagggaagaaggtggcggtgttcctggtggacacaggggatgccatgagccctgagctgagcagggaaacaaggatcaagctctgtgctctcaccacgatgctgagctcctaccagatcctcagcacctcccaggagctgaaggatacagacctggactatctggagatgtttgtccacgtggccgaggtgatgggcaagcattatgggatggtgccaatccagcatctggacctcttagttcgtgactcatcccaccccaacaaggcagggcaggggcatgtaggcaacatcttccagagattgtctggcagataccccaaggtgcaggagctgctgcaagggaagcgagcccgttgctgcctcttgcctgccccagggaggcggcggatgaaccaaggccatgcaagccctggtggtgacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaagaacctctcaggatggatggggaggacagggcccggtttcacctctccggatgagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgt

SEQ ID NO: 92 - DNA, 2051 bp, Homo sapiens
  misc_feature 1955, 2011, 2033: n = A, T, C or G
tcactatagggcgaattgggcctctagatgcatgctcgagcggccgccagtgtgatggatatctgcagaattcgcccttacgatttaggtgacactatagaaggtacgcctgcaggtaccggtccggaattcccgggtcgacccacgcgtccgcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttcttttttttttgtagttgggagtaaagtttgtgaatggaaacaaacttggttaaacactttatttttaacaagtgtaagaagactatacttttgatgccattgagattcaccttccacaaactggccaaattaaggaggttnaagaagtaattttttttaagcccaaccattaaaaatttaatacaacttggtttctncccctttttcctttaaagctantttgtaaaagtttatgag

SEQ ID NO: 93 - DNA, 1794 bp, Homo sapiens
gaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtc

SEQ ID NO: 94 - DNA, 5876 bp, Homo sapiens
caagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaaaccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataat

SEQ ID NO: 95 - DNA, 5618 bp, Homo sapiens
gttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagcagagcgagttaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaaggttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaac

SEQ ID NO: 96 - DNA, 5223 bp, Homo sapiens
gcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgcggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccaccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtctttttttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctg

SEQ ID NO: 97 - DNA, 4701 bp, Homo sapiens
gcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatgcaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacgcgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggagctggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcg

SEQ ID NO: 98 - DNA, 5061 bp, Homo sapiens
cagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactagttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatcc

SEQ ID NO: 99 - DNA, 4234 bp, Homo sapiens
tgagcacagatgatcaacagaaaatccaagcagctgcatttgacaaaggtgatgatcgaagacttggcaaaaagcctatattcagtagctcgcagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtagccataaaatctcgacctgtttcaagagttaccaatggaacttccaataaaaaaagtattcatgaacaagacactaatgtaaataacagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaagaaaggtgaaactttgaataataaagattcaaaacagaaaatgcctcctggacaggttatatcaaaaactcagccttcctcccaaagacctttaaaacatgaaacatctactgtccaaaaaagtatgtttcatgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcgttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccaaatgaaaactccttgaactctaatccagtttgtgatttagactcaacaagtgcagggcaaatccatttgatatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatatggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtaataatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaaataaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggagacatagatgattgtgacacactggcacaaacccgcatgtatgaccatcggccttcaaaaaccctgtctccaatatatgagatggatgtaatagaagcatttgagcagaaagtggaatcagaaacacatgttacagatatggattttgaagatgaccaacattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcagggtataacacatattgacactttgaacagatggagtgaactaacatctccacttgattcctcagcgagcatcaccatggctagtttttcctctgaagattgttcacctcaaggcgagtggacaattctggaactggaaactcagcattaagtgttaacattttggaaaaatttatgccactcctttattttttgatgcctatattatatccaaatgataattgcattagccggatataaactttctttaatattgagtctttccaatttaatgaggtaaacatagtttatttattaatatatcacatatagaaaaatgtttttctaaagtttttgagcatgttttctctaattattagagaaattagaagacttataaggaaaccctagcttcagttttcctttcctagctgatgatttgttcacttaatcattattcaagaatttaaaatgtgaatgcagaagtagatcagtccctttactttttgctctgcatagggtaacatagtaatttaacaataaaaacttaccgtgcttgtgtccaat

SEQ ID NO: 100 - DNA, 6377 bp, Homo sapiens
cttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggttt

SEQ ID NO: 101 - DNA, 3673 bp, Homo sapiens
gacgggctggggaggtggtgccaggctggttgctagctgccgccgctgctcaccccggccgtccggccgcttcattgtcaccgggcctcggggcagtgttgggggtggcggggcgccaggtcgccgacccgaggtttcggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccgctgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacgccaggcggcactgcccaccaggccctcaaggccaacaatgctggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgcgctgccccgccccaggacccatcacaggggcagatacgcctgggccagcgaggtgaccacggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcactgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcag

SEQ ID NO: 102 - DNA, 6873 bp, Homo sapiens
ccccaaccggcagcccatcggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcgttgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccgacgtgtcagaggaggccaaggaggagcagaaaggcctgtcttccccgttggccggcgaaggcagggccggcgggaacagcgaaaagcccaccgtgctgaagctcacgcggaaggagggcctgcagggaccggtggagacagagtccgtggtctgagccgcactcccgtttacacacattccagcgggcgggtgggcgggcgggcgggcggcggggccaggccatgggcgggagcagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccctgctcgtcccgtctgaaggactctcctaggaggccaggttgcccctccagacccctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgacttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctgggggccaccccttgcctgaggcttcccaccctcatctgaaggcccaggggccggatccagggctcaccaaagccgattcctcgccagctgggagtgcagaagtctcagggcctggctgcgacttgatttttaggaggaagaggggcttcgcaacccccctctgaatagtgtgttaacccttgagatcccagcctcgactaatctgaagtaaggacaacaaaggccattcagtgccctccacatggccttgccacagtcactgtcagggtatgaatgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagtgtgcagagcccaaatgaggggaccgcaggggctggggtccagggtcagtagagtcggtttctggagctgccttcctgggaggcaggtgtgggtgaccggggctctggcggtgcgtgtgggcccggcctggccacagcggggaccaggtcacgacatctttggcctcaacccctcccctgcactgagattatttccagattgcactcacttgaaaccgtccgtgtcgtcaccttgtgtcttaagggaagccgagaagaagggcagacgggcaggctgtcttgtctgcaaagcgccattgcgcccgcagcttgtgtgggtcaggctgcagctcgggtgtctgtggcttctaaccttgtacctcagacggatgcagtaacaaggcggggctggggacgccggtcagtgtcaaaggggaggtgctctggctgatagccttgcccgagagggacgaggaggccgtgcgggtgccccctggggaagctggccagccatccagtgctgaggacgcagctggagttgggctcgtggcacccttggggtgtgggctgtgcaggctggtggcctgggtgcctctgcacactgagtggagtgtcaggcagggtgtgtcggttggtcgagtcttgtgtaatgtgcgcagaccagttaccaaactaggataatgttggtctcatttgtggtggttttgttccctatacaagtcagctaagtaaagactcttttaacgagcttccccttaacacatggcagaagtttccaggtgcaggaatgcgagctggcgggaaggggcagaggccgtgagctctcagctgggccggcctgcctgtgtcccctttcctgggtctgtcggcagactggcatcatgacgttccctggtggctgaagagctagctttggagtgttgtttttctcactctcaggcaggggccttagctggaatcctccaacctgccactgaacacgtcagtgctgtgtgctgcctcttggacacctgcccttgaaagcctcaggcccctgggagaagcactctgtccagtcctgtccccgggggggaggcagggccactgagccctcctcagatggttagtggcttccaacagccatcaggagtgtttcttgaatgccccaggtgtggaggacttggtctgtgaccacctagaaccccagagctgaacaggaagccgtccctgcagcaacaagagggctggaagggggagctgcaggccaccctcggctctcccactgctggggcggtgatgttcgggtgacatgtttgaaaaatactcttaaagataccaactgttcccttatatggctaatggtttgtgcagccaccagcgatggcggcccctattagagaccaggtttgttaaaacaccaaatattgctgtccacactagacattaaccggcttcagaaaagatggacaccttttcccacgctgtttcgcttcttaactttggtccagctttagccaccacacagcgtgtgagggactgctgctgcggagtcagcctcgtttgtccctccgcctcccaccagcacgcgccgcttctgagagacaccagctccctgcctccaagcctggtgccacaggcctgtcgtgagggacccctgcttccgagagctcctgggggggttctgcccttcaccacctgggagaggtgtcagttcagttccgagttgaacaaggcccgtgcacacagcatgttgggggcccagcccaaagttcttgtcacctcctcatgcaaagccagccatcaccctccggccagagctcaaggtggccccttggccagcccctccttgggtcctccaggaggactgagcacccctcctagcggcatcccttgccctccacagtgctgccaggggcacgtcgctctgtgccgtggactgagaccatcccctggtgacagaatgacccgtttgttggaaatgcctcgttgccagagaaactccccaggcatctcggaacgaaactatttagttccattgtgaactggccacgggacagctttttatcaacttattaagttggagcactgtaatcgcgcttgctgagttagcagtggtggtaagcgtgtgttaaacacataatgttacgttttaggagagagaggtcgtaaggaagtgtcgtgtcgctcatgactctcttctattagttgggtaacagtggcctcatgtttgtgtctgtgtgtacacagagcccttaggttctgctctgtttctttgccaggtgaatgtttgtggcatgcgctgctgtccacgcccctctgtcctgcgcagggttcagctgtgcggcgccctgatttcctccatgcacacagaacctccttgtgtctgtttctctgttcctctgtggctgactcaataaacttttccctctg

SEQ ID NO: 103 - DNA, 4193 bp, Homo sapiens
gacagcaatggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtgtcagaaatgctcctccagcatcagtccaacccatgcctggtcaacaaggccaagaagacgcccctggacctggcctgtgaatttggccgactcaaggtggcccagctgcttctgaacagccacttatgtgtggcactgctggagggtgaggccaaagacccgtgtgaccccaactacaccacgcccctgcacttggctgccaagaatggccacagagaagtcatcaggcagctcctgagagctgggatcgagatcaaccgccagaccaagacgggtacggcgctccacgaggccgcactgtatggcaagaccgaggtggtgcggctgcttctggagggaggtgtggacgtgaacatccggaatacgtataaccagacggcgctggacatagtgaatcagttcaccacctcccaggccagccgggaaatcaagcagctactgcgggaggcctcagggatcctgaaggtccgagcgctcaaggatttctggaacctccacgatcccactgctctcaatgtccgggcaggggatgtcatcacggtgctagaacagcatcccgacggccgctggaagggccacatccacgagagccagaggggcacagaccgcataggctacttccccccgggcattgtcgaggtggtcagcaagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccagcaggtgacaggaatagtgtgggcagtgagggcagcgtgggcagcatccgcagtgccggcagcgggcagagctctgagggcactaatggccatggccctggcctcctgattgagaacgcccagccactgccctctgctggagaggaccaggtgctgccaggactccacccgccgtccctggcagacaacctgagccaccgccctctggccaactgccgctctggggagcagatcttcacccaggacgtgcggccagaacagctgctggaggggaaggacgcgcaggccattcataactggctaagcgagttccagctggagggctacactgcccactttctgcaggccggctatgatgtgcctaccatcagccgcatgacacctgaggacctgacggccatcggggtgaccaagcctgggcacaggaagaagatcgcctcagagatcgctcagctcagcatcgccgagtggctgcccagctacatcccaacggacctgctggagtggctgtgtgcactggggctgccacagtaccacaagcagctggtgagcagcggctacgactccatggggctggtggccgacctcacctgggaggagctgcaggagattggggtcaacaagctcgggcatcagaagaagctcatgctgggggtgaagcggctggcggagcttcggcggggcctgctgcagggggaggccctcagcgaaggcgggcgccggctggccaagggtccggagctgatggccatcgagggactggagaatggagaaggcccagctacagctggcccacggctcctcaccttccagggcagcgaactaagcccagagctacaggcggccatggcagggggtggccctgaaccactccccctcccacctgcccgctctcccagccaggagagcatcggggcacgctcacgggggtctggccactcacaggaacagcctgccccacagcccagcggtggagatcccagccccccccaggagaggaacctcccagagggcacagagcggccccctaagctttgttcttcacttcctggccaaggacccccaccctatgtttttatgtacccccagggctcaccctctagcccggccccagggccacctcctggcgcaccctgggccttctcctacttggccgggccccctgccactcccccagacccgcctcgacctaagcgccggtcccacagcctaagccgccctggccccacagagggggatgctgagggggaggccgaagggccagtgggcagcaccctaggcagttatgctacccttacccggcggccaggacgcagtgcccttgtccggaccagtcctagcgtgaccccaaccccagctcgggggactcctcgcagccagtcctttgccctgcgggcccggcgcaaaggccccccgcccccgccccccaagcgcctcagctccgtctctggccccagcccggagccacctccactagatgggagcccagggcccaaggaaggggccacagggccccgaaggcgaacactgagtgaacctgctggcccctcagagccccctggcccacctgccccggctgggcccgcgtcagacacggaggaggaggagccaggccctgaggggacgcccccatctcggggcagctctggggaagggctgccgtttgcagaggaagggaacctgaccatcaaacagcgcccgaagcccgctggccccccgccccgagagacacccgtgccccccggcctcgatttcaacctcacggaatcagacactgttaagcggaggcccaagtgccgggagagagagccactgcagaccgcactgctggccttcggagtggccagtgccacgcctggccccgctgccccactgccttccccaactcctggcgagtctcctccagcttctagccttccccagcccgagcccagcagccttccagcccaaggagttccaaccccccttgctcccagccccgccatgcagcctccagtgccgccctgcccagggccaggtctggaaagctcagcagctagtcggtggaatggggagacagaacccccggccgcccctgctgccctcctcaaggtgcccggagcaggaacagcccccaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctggacagggaccctggtaagagctctctcctcagggaggaagtaggggtggggctttgggggtgctttctctgtaccccccagcccatgtcccaagttgtgccaagggaatgcctcttgccacccaccatcctgcccaggccctgagaggctggaggaggcgtgtgtctggccgggccccctctccgtaggtgtacagaggacatgtaaatacacagcggtggtgcccaggcagctcctgcccccgccttccctcactgaggcagggctagcaggggtgggaggcagtggggttaacagatcccacaagtcctaacttttcaattgtaaatgttattttctaagcagagagaaatgcatatattttaaatggaatttattctatcaactgcctgagaggacacaatgggggaggggcttcggaccacagcaggagccccgactgcccacctgagggcagggagagcctgaccccattggcccaggccctggctctgtaaccattaacctcttcccccaactaacaccaatgaaaacaccattccacgtg

SEQ ID NO: 104 - DNA, 6496 bp, Homo sapiens
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccgcttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcttcttgcctctcaagggttgaggggtcctttctgtcaagtaatggttatttttcgtggtatcctgaggttcagggtgttttaagctgggggtaggtggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtatcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatg

SEQ ID NO: 105 - DNA, 5051 bp, Homo sapiens
ggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgcctttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgt

SEQ ID NO: 106 - DNA, 2977 bp, Homo sapiens
ggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 107 - DNA, 2752 bp, Homo sapiens
gtggccctgctggctgtgagagacaccccggacgaggagccggtggacagcgacacttcggagagcgactcgcaggaaagtggggaccaagaaacagaggagttggataatcctgagttcgtggccattgtggcctataccgacccgtcggacccctgggcccgggaggagatgttgaaaatcgcttctgttatcgagtcgctgggctggagcgacgagaaagacaagcgagaccccctccgacaggtcttgtccgtcatgtccaaggacactaacgggacccgcgtgaaggtggaagaggcgggccgcgaggtggacgccgtggtcctgcgcaaggccggggatgacggggacctccgggagtgcatttccaccttggcgcagccggatctccctccccaggcgaagaaggctgggcgtggcctcttcgggggctggagcgagcaccgtgaggacgaagggggtcttctggagctggtggcgctcctggctgcccaggacatggcggaggtgatgaaggaggaaaaagaaaacgcctgggaaggcgggaagtacaaataccccaaaggcaaactgggggaggtattggcgctcctggccgcccgggagaacatggggtccaacgaggggtcggaggaggcttcggacgaacagtccgaggaggagtcggaggacaccgagagcgaggcgtcggagccggaggacagggcatccaggaagccccgggccaagagggcgcgcacggcccccaggggcctgactccggccggcgcgcctcccaccgcttccggggcccgcaaaacccgcgcgggcggccgaggccgaggccgaggccggggcgtcactcccgagaagaaagccgggagccggggctcggcccaggacgacgccgcaggaagcaggaagaagaaggggagcgcgggctccggggcccatgccagggcaggcgaggccaagggccaggcgcccactggatccaaggccgcgcgcgggaagaaggcccgtcggggccggaggctgccccctaaatgccgctagtggccccccaagaagccgcccaggctgcgagcaggccccgcagggcacccgcccgcctgtggcccccgccctcccctcccctcttcctgtcctccgcagacgcaatctcctcgcttcacagcgcgcccgggccgcgttttgccagcgtcacgttcccctctcgggccctcgcaggccgggggcgccagcgatcccgacggaggaagcccggatgggaggaggaaagagaagtgggcgcccgaggcagcagcgcagggccgagatggggacgcgccaagtggaccaggattgggggcccgggttgcccccggagggggtgtgtgtgtggacgccgggcacctgcagaggcgagcagggctcttcgtggcgctctcggggcctgcgcctggcaggtgctgtaggccgctgtcgcccctaccccagtctgactgggccctgggtctgtggtggaggctcagtcaccagccgcgcagcgcgtgtcagggcgcaactctcagccaggggaggccccagctcccagccaggggaagagatgattccagaaaggaaagtctgagagatagaaggcggttgggaaggggaggaggaggaaaggggagaggaacggtgggagaagggaaagaggaggaggagggggaggggggagcagagggaagacacatgccagccctgcctactggggcgcccctgataacaaaggaaccagccccaggccaaggccacctgcccctgaccacaagttgaatttgtcactcagactgcagtgtttcccaacattctaattatttgcagaggtgttcaatttggggtaattcacttaaaatccagttttggttcttctgggctgagtgggccctggcccctcccataggctgtggctcccctgggtgccccctctccagtggagctgacccaccgctcagcgctggccttgcagcccttactaaaagacttgaaagtccctgggttcaccccctgagtgaattaaaggccagaggggccccgaagggcactgtgagggacagaggctcacctgggcagtgcagaagccggccgcgtgtccctccttacaggggatgaaatgacctggggaggaaaccccagccctgccctggaggttccagagtaggcgggccggtgctgtgaggcttcacaacctgctgtcccaagcacgcttgagttgtatgtgagtctgtgccgtgccgtgccgtatgcttcagctcctgcaaccccggctgagctcgatttttacctaaatatcagtctccacgggaccccaccttcattcatgccttcttgtccctggggcaatgtgtgtgcttcctcgtcccaatttccattccctggcagtgaggagcccatcgtgccagggggccctgccccacttgtccctgggaaggaataggagggtttgggtgtgacctcacagtccagaccagactgtcccagtcctatgtcagggacacccagatgtagaagctgactgagacctgctgcagggcgtgggtgctcccctctgcttggaggctgtccctggacagtgacccacccactgaggaccaggctgggtgtaccttgagctgggcacagcagcctgtggtgttgcctgtgggtggggagggccccaggtgtgcttctcccgtagcagtcctaggcttctctccctgtgccctgtgtcacctggatcctccagtaaagtgaaattcagcactgt

SEQ ID NO: 108 - DNA, 5217 bp, Homo sapiens
ggaggctgagggatgggaagagctggaacagcaggaggcggaggtgcaggggccgcccgaggcgttggaggagactggggagggccggcggggcgcggaggaggaggatctgggggaagaggaggaggagggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagcccccccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagagacccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaaccttttgtaatggttttttgattctatgcactaattttctttgtccaaaacatttactctaccatatgtctgggaatgtttatcctttctacagtaatggtgaaaggatcatatctagctaaaagcaagaacacccgttctcctgaatgcagtgagtaattgggaatcacaaggaacattctggcacccaactgtgcccatgttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagaccattctagatcagagctacaagttcactttctgtctctgagaatctccatctagggcagtagttcttatgatgtgtaggctccctcctagggcctactcaatcagagcctgtggggactgggccaggaatatgtattctggcaaaaactcttcaggtcagttctgatagatcccaaaggttaagaactgtgagaaacactgatcctaatgcaatctagtttttcagacttcgaaggggaggctcattcactcaaaaagcaacagtgagacaggaaaaataataaaacaaccccccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagttatttaccatgtagaaaccattttctttctagaaacaatagctcagcctcactgtagcagctggcatgtgtggtcaagtggatagttgtactcttgcaagttggatttaatatcatatatactggaccttcagactgttaaaaatcaatgtaacctttttttattgctatggcaagcaattagtatttcactgcacgtcttccatactaatgttcatttctaaatcttatatgtaggcatttgttagttccaatgatttcctcactaatataacactttttaatgggaatctttccacctacagccctggaatgataatgctacagtaattcttctgaattgactttttctttcatcctgtcagctttggacaatatcccaattatggcagggaacaggtggggaactaagatcagttacaaaaagttgtagatgtgtcaactttgtattggctgggatatcactgtgcccaaacaaaacaggcgaaatacctcagttaaaatttttccatcaaagtctttaaaagaagagtatactgaagaaagggcagtcataatacttacttctaacagcttctaaagggtacatgtttaacatttcatttcaaaatcaccccaaatttgcactaaataccaatgaagtgttattttgctttagtagtcttctgagcaacaaactatggggaattctgtaaaaacatataaaaagttcaagactttttttttaaatgaatgattactatgttaaatgcaaactttttttttttttatttaaacaaacatacacttctcctggcaaggttatagatgattaacctctgttcatagacttatatataaaactagagggttttttgtttacttttttaatttttcaagtgcaattgtttcttacacagacattattactattaaattatcatttagccagttatctgcaaatatatagtatgtattgtctcttcttgtgacgtttagtttaattgcttattttaaagcagaaacattagttacaagtgtcttacaatatttttaccaacagtaaagtagagacttaatgaaaataccttagtgtgattttaatataatttgcatattttagttgtataaagttttaatgtaaaatgtccattattgaagggaaaagatctttcaataaaaaatacccacgag

SEQ ID NO: 109 - DNA, 5676 bp, Homo sapiens
agcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggatgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccaaatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagcccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatcagggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttcttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggattttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaac

SEQ ID NO: 110 - DNA, 5561 bp, Homo sapiens
atggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcacaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaac

SEQ ID NO: 111 - DNA, 5654 bp, Homo sapiens
cggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggccttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagctgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaacatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaagagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgatgtttgacatacctgagaaaaacaagaaatggggaaaggattccctatttaataaatggtgttgggaaaactggctagccatatgctgaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctgatgttttgttaaacctgataagttttgtactagtaaaattctagaattctaagcatagatttaaacattgctgaaaaatgagtttgtgtgttttatgccttccaggggacagttaagtgggcagtatttatttaatatacctgcttcagccccatttgaattgtaagcactctgaaagcatgtctcatagtcgtctgtatccctggtgtctcccacagtgccctgcttacctgcaggcctttttgtattttctgtccaagtaccctaatagggtggtgcagaatggatgtacagatctgtggatgacctcagcagcttaatccaaggcacccctcgggaagcctgaaatgtctttgaagtcttatgtattatcctaaaatccattgacattttatattctaccctacaaaataagtatgtgttactatttttctttccaaattgttgagtaaaactcactgtattcatcctgtggctttgtactgcccagcctagctcattgttttttacctgcctcatttcctgagctgggcattgctcagtttcagaaggtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccactgtaatatgaagaattctttttattttttaagagattctaagaaaatgttcacattatcaaaactagaattctatcaacttttaagacatttaattatttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtatgctttaattattaattttaaagagtgagctctaagaatgaacacatcagatgtaagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctct

SEQ ID NO: 112 - DNA, 5008 bp, Homo sapiens
gctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccaggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagacccccggttgcccattcatggctgcaccccaccatgtcaaacccaagaccagccccaaggccagaccaaggcatgtaggcctgggcaggtggctcggggccactggcggagccagtctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagcccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctaccccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtctt

SEQ ID NO: 113 - DNA, 7737 bp, Homo sapiens
gggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtgaggatggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggtttggtatctatgcagtggttcacctcctccttcctgtgatgtccgtttggctccgccggagccataaagaccattcctactgggatatggcctctgccaatttcaagcacgctattggtctgtcctgtgagctggtggtggagcacattcaaagctttctacattcagatatcaggtacgagagcatgatcaataccatgctgaaggacctctttgagttgctggtcgcctgtgtggccaagcccactgaaaccatctccagagtgggctgctcctgtattagatacgtccttgtgacagcgggccctgtgttcactgaggagatgtggaggcttgcctgctgtgccctgcaagatgcgttctctgccacactcaagccagtgaaggacctgctgggctgcttccacagcggcacggagagcttcagcggggaaggctgccaggtgcgagtggcggccccgtcctcctccccaagtgccgaggccgagtactggcgcatccgagccatggcccagcaggtgtttatgctggacacccagtgctcaccaaagacaccaaacaactttgaccacgctcagtcctgccagctcattattgagctgcctcctgatgaaaaaccaaatggacacaccaagaaaagcgtgtctttcagggaaattgtggtgagcctgctgtctcatcaggtgttactccagaacttatatgacatcttgttagaagagtttgtcaaaggcccctctcctggagaggaaaagacgatacaagtgccagaagccaagctggctggcttcctcagatacatctctatgcagaacttggcagtcatattcgacctgctgctggactcttataggactgccagggagtttgacaccagccccgggctgaagtgcctgctgaagaaagtgtctggcatcgggggcgccgccaacctctaccgccagtctgcgatgagctttaacatttatttccacgccctggtgtgtgctgttctcaccaatcaagaaaccatcacggccgagcaagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagtcccgggagcacatgggcgagtccctgagcctgaaggccggtggtggggacctgctgctgccccccagccccaaagtggagaagaaggatcccagccggaagaaggagtggtgggagaatgcggggaacaaaatctacaccatggcagccgacaagaccatttcaaagttgatgaccgaatacaaaaagaggaaacagcagcacaacctgtccgcgttccccaaagaggtcaaagtggagaagaaaggagagccactgggtcccaggggccaggactccccgctgcttcagcgtccccagcacttgatggaccaagggcaaatgcggcattccttcagcgcaggccccgagctgctgcgacaggacaagaggccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtagccgactcctgttctactctcccaccaaataacagtagtgagggttagagtcctgccaatacagctgttgcattttccccaccactagccccacttaaactactactactgtctcagagaacagtgtttcctaatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaatatctgctggtaagtcaagctgataaacactcagacatctagtaccagggattattaattggaggaagatttatggttatgggtctggctgggaagaagacaactataaatacatattcttgggtgtcataatcaagaaagaggtgacttctgttgtaaaataatccagaacacttcaaaattattcctaaatcattaagattttcaggtattcaccaatttccccatgtaaggtactgtgttgtacctttatttctgtatttctaaaagaagaaagttctttcctagcagggtttgaagtctgtggcttatcagcctgtgacacagagtacccagtgaaagtggctggtacgtagattgtcaagagacataagaccgaccagccaccctggctgttcttgtggtgtttgtttccatccccaaggcaaacaaggaaaggaaaggaaagaagaaaaggtgccttagtcctttgttgcacttccatttccatgccccacaattgtctgaacataaggtatagcatttggtttttaagaaaacaaaacattaagacgcaactcattttatatcaacacgcttggaggaaagggactcagggaagggagcagggagtgtggggtggggatggattatgatgaaatcattttcaatcttaaaatataatacaacaatcttgcaaaattatggtgtcagttacacaagctctagtctcaaaatgaaagtaatggagaaagacactgaaatttagaaaattttgtcgatttaaaatatttctcctatctaccaagtaaagttaccctatgtttgatgtctttgcattcagaccaatatttcaggtggatatttctaagtattactagaaaatacgtttgaaagctttatcttattatttacagtatttttatatttcttacattatcctaatgattgaaaactcctcaatcaagcttacttacacacattctacagagttatttaaggcatacattataatctcccagccccattcataatgaataagtcaccctttaaatataagacacaaattctacagtattgaaataaggatttaaaggggtatttgtaaactttgccctccttgagaaatatggaactaccttagaggttaagaggaaggcagtgttctgacttctttaggtgatctgaaaaaaacacccttatcatccagtgtaccatctagagatcaccacagaatccatttttttcccagttccacaaaacactctgtttgccttcagtttttactcactagacaataattcaagtttagaaacaggtaatcagctatttgatcttaaaaggcaatgaattgttgggatatcagtgaactatgttgtatacttttgaatttttacattttataaatggaattgaaagttggataactgctttttttaaattttccaacagaagtaacaccacagttgctttgtttctttttatagcttacctgaggttcagttcttctttgtgaacctgtgagtactccacagtttactgggggaaaaggcttcagtaaagcagaggctagaattacagtatttatacatagcaacttttcataaagtagaaaaattcaaaggaagctgtctcaatttgagaataccagctgggcacggtggctcacgcctgtaatcccagcacttactttgggaggccaaggtgggcagataacctgcggtcaggagtttgagaccaggctggacaacatggtgaaacctcgtctctactaaaaatacaaaaattagccaggtgtggtaggatgcacctgtaatcccagctacttaggaggccgagacaggagaatcgctcgaacccaggaggcggacgttgcagtgagccaagattgcaccattgcactccagactgggtgacaagagtgaaactccatct

SEQ ID NO: 114 - DNA, 2764 bp, Homo sapiens
agagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcgtttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaag

SEQ ID NO: 115 - DNA, 5979 bp, Homo sapiens
ccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgcccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtaaagagaccaggagccacctcaatcagcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagat

SEQ ID NO: 116 - DNA, 2754 bp, Homo sapiens
gcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgat

SEQ ID NO: 117 - DNA, 5231 bp, Homo sapiens
cacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgatttttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaaacaagtcagtggcttaaatgtgattatggtcctgcaaggtgattcttgctaaaatatctaaacttttgttttgttttaactgaatcattttttaacttaaaaagctggaaaatatcaaatgctgtttttttttttcattgtcaacagtggtgtgtcattttatgtatgttcctaatgcttatggaactcctccaaaataaagttactcaaagag

SEQ ID NO: 118 - DNA, 5484 bp, Homo sapiens
tggcgaggcgggaagcacccggaatcttcctggccctagagcctgcaggctccaggccggccccttgaatctcaccgcgaggaaggcaccctgctgcctgcacttatttgcatccaagagtttgcattgagactggcgcttgcctactagggcagccacaggggggttccccagggacagagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggctatctccccctctggctcagtcatcgcctgcccacccttcacttcttaaaggtgcgcaagagaggagggccgactggagggtgtcgccggaaggtttcagcctgcccttcacaattccccttgtgcacagcccagttttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 119 - DNA, 3978 bp, Homo sapiens
gtcactgagaagatggatgtgctgggcaccgtgggaagctgtggggcccccaacttccggcaggtgcagggtgggctcactgtgttcggcatgggacagcccagcctcttagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaggaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttcttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccagcaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtg

SEQ ID NO: 120 - DNA, 3853 bp, Homo sapiens
ggccgcggggcctggagcccgggatttgtgggcggcgagggcgcgaggggccgcgcgccatgctccgggccccgacggcgcggacgccccctcgcgcgccagcgtccggcgcgaccccggatcccggtctgcgcattgccccccgacggctgcgctagggagcgcggggcccggcggggggcggccgagctgggcgccctcccccggcgcggagtccccgcaccccggagggatggggcgggcagccgcgggcgcctaagatgccggccatgcggggcctcctggcgccgcagaacaccttcctggacaccatcgctacgcgcttcgacggcacgcacagtaacttcgtgctgggcaacgcccaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgacattgtgctgaatttccgtaccacattcgtgtccaagtcgggccaggtggtgtttgccccaaagtccatttgcctccactacgtcaccacctggttcctgctggatgtcatcgcagcgctgccctttgacctgctacatgccttcaaggtcaacgtgtacttcggggcccatctgctgaagacggtgcgcctgctgcgcctgctgcgcctgcttccgcggctggaccggtactcgcagtacagcgccgtggtgctgacactgctcatggccgtgttcgccctgctcgcgcactgggtcgcctgcgtctggttttacattggccagcgggagatcgagagcagcgaatccgagctgcctgagattggctggctgcaggagctggcccgccgactggagactccctactacctggtgggccggaggccagctggagggaacagctccggccagagtgacaactgcagcagcagcagcgaggccaacgggacggggctggagctgctgggcggcccgtcgctgcgcagcgcctacatcacctccctctacttcgcactcagcagcctcaccagcgtgggcttcggcaacgtgtccgccaacacggacaccgagaagatcttctccatctgcaccatgctcatcggcgccctgatgcacgcggtggtgtttgggaacgtgacggccatcatccagcgcatgtacgcccgccgctttctgtaccacagccgcacgcgcgacctgcgcgactacatccgcatccaccgtatccccaagcccctcaagcagcgcatgctggagtacttccaggccacctgggcggtgaacaatggcatcgacaccaccgagctgctgcagagcctccctgacgagctgcgcgcagacatcgccatgcacctgcacaaggaggtcctgcagctgccactgtttgaggcggccagccgcggctgcctgcgggcactgtctctggccctgcggcccgccttctgcacgccgggcgagtacctcatccaccaaggcgatgccctgcaggccctctactttgtctgctctggctccatggaggtgctcaagggtggcaccgtgctcgccatcctagggaagggcgacctgatcggctgtgagctgccccggcgggagcaggtggtaaaggccaatgccgacgtgaaggggctgacgtactgcgtcctgcagtgtctgcagctggctggcctgcacgacagccttgcgctgtaccccgagtttgccccgcgcttcagtcgtggcctccgaggggagctcagctacaacctgggtgctgggggaggctctgcagaggtggacaccagctccctgagcggcgacaatacccttatgtccacgctggaggagaaggagacagatggggagcagggccccacggtctccccagccccagctgatgagccctccagccccctgctgtcccctggctgcacctcctcatcctcagctgccaagctgctatccccacgtcgaacagcaccccggcctcgtctaggtggcagagggaggccaggcagggcaggggctttgaaggctgaggctggcccctctgctcccccacgggccctagaggggctacggctgccccccatgccatggaatgtgcccccagatctgagccccagggtagtagatggcattgaagacggctgtggctcggaccagcccaagttctctttccgcgtgggccagtctggcccggaatgtagcagcagcccctcccctggaccagagagcggcctgctcactgttccccatgggcccagcgaggcaaggaacacagacacactggacaagcttcggcaggcggtgacagagctgtcagagcaggtgctgcagatgcgggaaggactgcagtcacttcgccaggctgtgcagcttgtcctggcgccccacagggagggtccgtgccctcgggcatcgggagaggggccgtgcccagccagcacctccgggcttctgcagcctctgtgtgtggacactggggcatcctcctactgcctgcagcccccagctggctctgtcttgagtgggacttggccccaccctcgtccggggcctcctcccctcatggcaccctggccctggggtcccccagcgtctcagagctccccctggcctcgagccacagctttctggacctccacctcagactcagagccccctgcctcaggagacctctgctctgagcccagcacccctgcctcccctcctccttctgaggaaggggctaggactgggcccgcagagcctgtgagccaggctgaggctaccagcactggagagcccccaccagggtcagggggcctggccttgccctgggacccccacagcctggagatggtgcttattggctgccatggctctggcacagtccagtggacccaggaagaaggcacaggggtctgagtaccagccctagaactcagcgttgccaggtgtgctgccatctgctgttcggcccaacctcagagtgaaggcagggtggcagcctccccacggactccatgcggcccgctggctcagggcagggagcctggaagcaaaggaggacctggctcctgactctcagagaggataggctggatccctggggcaggcctctcctcggcctgctcctctgacctcccggtctccctctgcaggctgggggcagaggcctgaggacaaggaagagctttgccatcccctgcatgtgcccctgcctctacctgtccccaaatttttatattaaaaaaaaaaaataaaat

SEQ ID NO: 121 - DNA, 6018 bp, Homo sapiens
attccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctgaagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcccccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggc

SEQ ID NO: 122 - DNA, 2839 bp, Homo sapiens
ggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacaacatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaatgcccccgggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccgcagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaacggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaag

SEQ ID NO: 123 - DNA, 6524 bp, Homo sapiens
gaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcactttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccccggactcaacagctgcgtctccatgacaggagaatgccagggtcctggtggttggcacagagccctgttccctgcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcgtctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcaacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcggggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcccttaatccttacggcaagcctgtgaggcggataggaccagccctgatctatagtgagaaaattaaggttcagagggagaaggtccaaatagtggccaagctgggactgagatctcgagtttgggtttgtttgggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacattttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccattcgacttctttcctttttttttttaaaataaaaaaagtgcttgactggtttcaagcttcatcatg

SEQ ID NO: 124 - DNA, 6043 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcaggtgggaccggaaccggaacccccctcttcaagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggaggcaggtgcaccgggaaaatgtgtctgagtcctgcttggcagaagagaaactgagtcaccagcttaggagtcgcagggtcagcgggcctgaagggggctgggtctgtctgcggtgcggaggattgggtgggcctgtgtgagccgaggtggccgctggctggagattggtttgcacttcttggctgggttcccccgtgctccatgactcctgcatctcctgattgtttctcgttggtttggagttgtccctgcggttggagccatctgagcttgtagggtcgaggcccaggaggaaggggagggttcaccgacttacagcctggctgtaggtttgaacaggagtctgaggtcgctgagggtttggggaggctttcctgagctgctctggccccagtcctggggctgtcaccttccagtattgcgtggcgggaggagcgctaacaagagccaagggttgtaaattccacacccagctctgccactttctagttgtaagaccttgagagggctcctcctttctctaatttctattttagaaaattggaacaataatattcttctcccacatgaagatagtaacaatggcagtcgttcagcggatgcttactttgcgttcagcgctgacataccccattccatgtaattctctcaacatttcgaggggagggatcattagctttgtttaacagatagaaaaacggaggctcagagaggacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaaggtaagataaccaagtgggagcctctagaatggctcatgggaagtgtgacatgaatattggaggatccgatgtagagggggggtgatctggaaaagttcccttttttagggggaaggtgctccaaagccctctactgctggatccaaagctaaggaaagtgggggcaaatgtggcaggctcggggcaggttagacgctggggagccagttggctggggcctgcagggtgccaggatctgggagagggaagggaggtgttgggctcccttccccattgctctctgcggagtctgaagtagggtcggacgtctctggctgggggtgggatgcagcctccggtgcgccctcagcagtgaccctcgtgtgtgcctctctcttcctttcgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcg

SEQ ID NO: 125 - DNA, 6747 bp, Homo sapiens
tgggtctgggttgacagaagtctgcagggctggcagcaaacattccaggccaattccactgccagatcaaagaccaagcgcaaatcctgggggaattggggaggaagccccatgtagacacccaagggaagctttagatggccctgtcttctcaaggaaccctgaaggcagcaggactctcagcccgtctagagggaaagagagcagaactcttccttgccgacagccatgcagttctcaacctgttgctactcatgcttattcctcccattcctctactttactgtgttttagagatggtgacctagggaaggagcctttcaaggctgccccacatactatccacccaccctgtgtagtaccttccagggcctatgaaatggatgagacaggagagatctctaggggacctgatgtgcacttgacacatggccttgagcccaaagatgttaacagggaatttaggctaacagagagcagcacctgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgagagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcgatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatgtggcccggtgctccagcatggacaatggcctagaagaccagaactcccctttccactcccacctcagcacttacgccaatatttgtgatctgtcaaccacacacagcagcactgagaatgcccagggttcaaatgaggcctgggaagtattccgagggagttcttcaattgccttaggagacccccacatcccgacgagccctgaaggagtagcccccacttcgggtcatgacagaaggcctcagttcaggggcccttctggtgaagcagactgtctgaggagtaagccccccttggccaaaggaagtgctgcaggtccagtggatgagattatgctgctgtatccatcagaggcaggctgccctgtgggacagaccaggacgaacacattcgaacagggcacacagaccctcggcagcaggcgccactggagcagcactgacatctcctttgctcagcctgaagccagtgcagtatcagcctttgatctggcctcatggaccagcatgcacaatctgtctctccacctctcacagctcctgcacagtacctcagagctgcttgggagtctctcccagccagatgtggccagaagggagcagaacaccaagagggacatcccagataaagccccacaggccctgatgatggatggctctactcagaccactgtggatgagggcagccagactgacctcaccttacccaccctgtgcctccagacttcagaggctgaacctcagggagccaatgtgatccttgaagggctaggctcagatacctcgactgtgtctcaagaagagggagatgtgccaggggtacctcagaagagagaggcagaggaaacagcacagaaaatggctcagctcctctatcttcaggaagaaagcactccctacaagccccagagcccttcaataccctcatcccacttgaggtttcagaaagcccccgttgggcagcatcttccttctgtgagcccctcagtttctgatgctttcctgcctcccagctcccagccagaggagtcatattgcttagttgtcagcagtcccagtcccagctcccctcattccccagggctctttcccagtacttccgagtatcctggggactccagggtccagaagaagctgggccccacaagtgctttgttcgtggacagggcctcctccccaatcctcactcttagtgccagcacccaagagccgggtctttccccaggctctttgaccctctcagccccttcaactcaccctgttgaaggccaccagaagcttgactccagcccagaccctgttgatgccccaaggactccaatggataattattcccaaaccactgacgagttaggtggctcccagagaggtagaagttccttacaaaggagtaatgggagatccttccttgagttgcactccccacacagcccacagcagagtccaaaactccaatttagtttcttagggcagcaccctcagcagcttcagcccaggacaactatcggggtccaaagcagactgctgccaccaccactgaggcacaggagccaaaggctgggcaacagctttgtgcctgagaaggtggcttccccggagcattgcccactgagcggtagggagccaagtcagtggcagagcaggacagaaaatggaggtgagagttcagcatctccaggggaaccacaacgcactctggaccgaccttcttcatggggaggcctccagcacctcagcccctgccctgtctctgagttgactgatactgcagggctccgaggttctgccttgggcctccctcaggcctgccaacctgaggagttactgtgcttcagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctggtgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcacggggagatcctgcccagtgcctggatcttgcagcccatcactgtggaagggaaggaagtcaccagagtcatctacttggcccaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctctgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgctctgaatctacctcctctagcattcagctctactgtgtgatgggacgttaaaaataccaaaacagaaagagggtttaagaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttgggggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttc

SEQ ID NO: 126 - DNA, 6926 bp, Homo sapiens
atttgagcatcagttgagggagaggacgcttcatttcctttttggttgggaatgtgccgtgaacatcctctgctggagcttggggcctggagcagactggggctgcagatttagacgtagacgtttccgaggacgcgagactgcagagctttgtaggcagccaatcccagagaagcagacgggatggctagttcagcccgggagcacctgctttttgtgaggcgtcgaaatccccagatgcggtacacattgagcccagagaacctccagagccttgccgcccagagctccatgccagagaacatgaccctgcagcgggccaacagcgacaccgacctggtgacttctgagagccgctccagcttaactgccagcatgtacgagtacacgctggggcaagcccagaacctcattatcttctgggacattaaagaggaggtggaccccagtgattggattggactttatcatatagatgagaattctccagccaacttctgggattctaagaacaggggtgtgactggaacacaaaaagggcaaattgtatggagaattgagcctgggccctatttcatggaaccggagataaaaatctgttttaaatattaccacggcattagtggagccctgcgagccacgaccccctgcatcaccgtgaagaacccagctgtgatgatgggggcagaaggcatggagggaggtgcttcaggaaacctgcattctcgaaaacttgttagctttacattgtcagatcttagggcagttgggctaaagaaagggatgttcttcaatcctgacccttatcttaagatgtcaattcagccaggaaagaagagcagtttccccacctgtgcccaccacgggcaggagagacggtctactatcatcagtaacaccaccaatccaatttggcaccgagagaaatattccttttttgcacttcttactgatgtcttagaaattgaaattaaagacaaatttgccaagagccgtcccatcatcaagcgttttctggggaaactaaccattccagtccagaggctgctggagcgacaagccatcggtgatcaaatgctcagctacaaccttggcagaaggctcccagctgaccacgtgagtgggtacctccagtttaaagtggaggttacgtcttctgttcatgaagatgcctctccagaagctgttggcacaatacttggagtcaattctgtgaatggagacttaggtagcccttccgatgacgaggacatgccagggagccatcacgacagccaggtgtgctctaatgggccagtttctgaggacagtgctgccgatggaacccccaagcattcattcaggactagctccactctggaaatagacacagaggaattaacctctacgtcttcaaggacctcacctcccagaggacgtcaggattcactcaatgattacttagatgctatcgaacacaatggccactccaggccagggacagcgacctgctctgagaggtccatgggtgcctctccgaaactgaggagtagttttcccactgacacaagactcaatgccatgcttcatattgattcagatgaagaagatcacgagttccagcaagacctgggttacccatcttccttggaggaggagggaggcctgatcatgtttagcagggcatccagagctgatgatggaagcctgacatctcagacaaagctggaggacaaccctgttgagaatgaggaagcctccacacacgaagctgcttcctttgaggataagccagaaaatcttccagagcttgcagagagctccttacctgcaggcccagccccagaggaaggtgaaggcggcccagagcctcaacccagtgctgaccagggcagtgctgaactgtgtggctctcaagaggtagatcagcccacaagtggcgcagacacagggacttccgatgcatcaggaggaagccgaagagccgtcagtgagaccgagtctctcgatcagggctctgagccttcccaggtgtcctctgaaacagaacccagtgatcctgccaggacagagagtgtgagcgaagccagcaccaggcctgagggagagagtgacctggaatgcgctgacagctcctgcaatgagagtgtgaccacgcagctgtcctctgtggacacacggtgctcctctcttgagagcgcacggtttcctgaaaccccagccttttcttctcaggaggaggaagacggagcctgtgcagcagagcccaccagcagtggccctgccgaagggtcgcaggaatccgtgtgcactgctggttctttacctgtggtacaggtgcccagtggggaggatgaagggccaggggcagaatcggccactgtacctgaccaggaggagctgggggaggtctggcagcggagggggagcctggagggagctgcagctgctgccgagagcccaccgcaagaagaaggcagtgctggggaggcccaaggcacctgtgaaggggcaactgcccaggaggagggcgctactggaggttctcaagccaacggccaccagccactgcgatcactaccttcagtgcgccaggatgttagccggtaccagagggtggacgaggctctcccaccaaactgggaggcacgcattgacagccacggcaggatcttctacgtggatcacgtaaacagaaccacgacgtggcagcgaccgacagctcccccagccccgcaggtgctgcagagatctaactccatacagcaaatggagcagctgaaccggcgatatcagagtatccgcagaaccatgaccaatgagaggcctgaggaaaataccaatgctattgatggggcaggggaggaagctgactttcaccaagccagtgcagatttccgacgggagaacatcctgcctcactctacctccagatccaggatcacgttgctgttacagtctccccccgtgaagttcctcatcagcccagagttcttcaccgtgctgcattctaaccctagtgcctaccgcatgtttacaaacaacacgtgtttgaagcacatgatcaccaaagtccggagggacacccaccactttgaacgctaccagcataaccgcgaccttgtgggattcctcaacatgttcgcgaacaaacagctagagctgccgcggggatgggaaatgaaacatgatcaccagggcaaggcattctttgtggaccacaactcccgcaccaccactttcattgatccccggctcccacttcagagcagtagacccacaagtgcgctggttcatcggcaacacctgacaaggcaacgcagccacagtgcgggtgaggtaggagaagattctcgacatgcaggaccaccagttcttcccaggccatccagtacattcaatacagtcagtaggccacagtaccaggacatggttccagtggcttacaatgacaagattgttgcatttctacgtcaacccaatatctttgaaattctacaggagcgtcaacctgatcttaccaggaatcactcactcagggagaagatccaatttatccgaactgaagggactccaggattggtgcgcctttcaagcgatgcagaccttgttatgttgctgagcttatttgaagaagagataatgtcatatgtgcctccacatgccttactccaccccagctactgtcagtccccacgtggctctcccgtgtcatctcctcagaactcgccaggtacccagcgtgccaatgcccgggctccagccccttacaagcgggatttcgaagccaaactgaggaacttttacaggaagttagagactaaaggatatggacaaggcccagggaagttaaagttaattatccgaagagatcacttactagaagatgcttttaatcagattatgggctactccagaaaagacctgcagagaaataagctatatgtcaccttcgttggggaggaagggctggattacagtgggccttctagagagtttttcttcctggtatccagagaactctttaacccatattatggcttatttgaatattcagccaatgacacatacacagtacaaataagtcctatgtctgcttttgtagacaatcaccatgaatggttccgattcagtggtaggatccttggtcttgcactaatacaccagtatttgttggatgccttcttcacacggcccttttataaggctcttctcagaattctatgtgacctgagtgacctagaataccttgatgaagagttccatcagagcctgcagtggatgaaagacaatgatatccatgacatcctagacctcacgttcactgtgaacgaagaagtatttgggcagataactgaacgagaattaaagccagggggtgccaatatcccagttacagagaagaacaagaaggagtacatcgagaggatggtgaagtggaggattgagaggggtgttgtacagcaaacagagagcttagtgcgtggcttctatgaggtggtggatgccaggctggtatctgtttttgatgcaagagaactggaattggtcatcgcaggcacagctgaaatagacctaagtgattggagaaacaacacagaatatagaggaggataccatgacaatcatattgtaattcggtggttctgggctgcagtggaaagattcaacaatgaacaacgactaaggttgttacagtttgttacaggcacatccagcattccctatgaaggatttgcttcactccgagggagtaacggcccaagaagattctgtgtggagaaatgggggaaaatcactgctcttcccagagcgcatacatgttttaaccgtctggatctgcctccctacccatccttttccatgctttatgaaaaactgttgacagcagttgaagaaaccagtacttttggacttgagtgacctggaagctgaatgcccatctctgtggacaggcagtttcagaagctgccttctagaagaatgattgaacattggaagtttcaagaggatgcttcctttaggataaagctacgtgctgttgttttccaggaacaagtgctctgtcacatttggggactggagatgagtcctcttggaaggatttgggtgagcttgatgcccagggaacaacccaaccgtctttcaatcaacagttcttgactgccaaactttttccatttgttatgttccaagacaaagatgaacccatacatgatcagctccacggtaatttttagggactcaggagaatcttgaaacttacccttgaacgtggttcaagccaaactggcagcatttggcccaatctccaaattagagcaagttaaataatataataaaagtaaatatatttcctgaaagtacattcatttaagccctaagttataacagaatattcatttcttgcttatgagtgcctgcatggtgtgcaccataggtttccgctttcatgggacatgagtgaaaatgaaaccaagtcaatatgaggtacctttacagatttgcaataagatggtctgtgacaatgtatatgcaagtggtatgtgtgtaattatggctaaagacaaaccattattcagtgaattactaatgacagattttatgctttataatgcatgaaaacaattttaaaataactagcaattaatcacagcatatcaggaaaaagtacacagtgagttctgtttattttttgtaggctcattatgtttatgttctttaagatgtatataagaacctacctatcatgctgtatgtatcactcattccattttcatgttccatgcatactcgggcatcatgctaatatgtatccttttaagcactctcaaggaaacaaaagggccttttatttttataaaggtaaaaaaaattccccaaatattttgcactgaatgtaccaaaggtgaagggacattacaatatgactaacagcaactccatcacttgagaagtataatagaaaatagcttctaaatcaaacttccttcacagtgccgtgtctaccactacaaggactgtgcatctaagtaataattttttaagattcactatatgtgatagtatgatatgcatttatttaaaatgcattagactctcttccatccatcaaatactttacaggatggcatttaatacagatatttcgtatttcccccactgctttttatttgtacagcatcattaaacactaagctcagttaaggagccatcagcaacactgaagagatcagtagtaagaattccattttccctcatcagtgaagacaccacaaattgaaactcagaactatatttctaagcctgcattttcactgatgcataattttcttattaatattaagagacagtttttctatggcatctccaaaactgcatgacatcactagtcttacttctgcttaattttatgagaaggtattcttcattttaattgcttttgggattactccacatctttgtttatttcttgactaatcagattttcaatagagtgaagttaaattgggggtcataaaagcattggattgacatatggtttgccagcctatgggtttacaggcattgcccaaacatttctttgagatctatatttataagcagccatggaattcctattatgggatgttggcaatcttacattttatagaggtcatatgcatagttttcataggtgttttgtaagaactgattgctctcctgtgagttaagctatgtttactactgggaccctcaagaggaataccacttatgttacactcctgcactaaaggcatgtactgcagtgtgaagaaatgttctgaaaaagggttatagaaatctggaaataagaaaggaagagctctctgtattctataattggaagagaaaaaaagaaaaacttttaactggaaatgttagtttgtacttattgatcatgaatacaagtatatatttaattttgc

SEQ ID NO: 127 - DNA, 5796 bp, Homo sapiens
ctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaaggtgactgcctgcccttctccccaatatcctttcccatctccccactccaaatccatgcatggggccaggaagccctggatcctgaacacagcttctagaaggttccccatctggcagctggcctggggtgcccccacagggcagtgggatctgctgatcttaccgtctccctcagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtaagccggcgggggtggcctgggtgcctccctccactggcggcaaatgcaccctgaacacagtgcaccatccctgccctcccggggtctaccttgtagttggcggggaaggacagatgtcagccaggtacagaaatgaagaaggtagtgatcagggacaaggctggcctgagggcagagggggaggaaaggagcagccgtgcaaagcccccaggagctgaaggggcggtgctgtaggggaggtgaggtcagggaagtatccagggcctggccacataggccctgagccctgccaggacctcgactttctcggggaggaagacaggagcaatgatggctggcttctctgtctggcgtgggctggtaccagagccgcaggggtgttggttaggaggccgctgtggcaaccaggctgggagccctggaaggggccagcagggtcagagtctagacaggatttggagacagcagatgggaattgctcacagaatgggtttgcctgggggctctttcttcatcctccaggtgtcctgcgacagatgaaccatttgtaacccccaccctctgtaccccagccctgggtcaggtgccccattattcacacacgctcctgacccctcattgccaggagctagcatggttgtcattaagcagtcacctgtggccctatgtccgagttccgcctgtgctctggccctcagggtcaaggtagcaggggcctggcctatgctgaccacactgagcatcctggccggcccctcctttcttacctccagggcttggactagggactgtctgttccccaggctcagtgatgctgttatcctggaggggcaagtgcttctcaaggaagtgtgggaggagggaacagtctcttacaggagaagcagggtaggcactgctgggacagacccctcctcattccatggaggcctcacatggggaacagaaggacggaggcctcacttggggagtaggagaatgtgacaaggccctctccggacccagcacctggccagaggctgtgagtgcctgtgcttggtgctgaggggactccagagggtccttggccactgcactctgggggagccgctccagggtcttttccctgatggtccatcccccgccgcgatgcaggtgaccagccaagataaggctccggctgtaatccgcaaggccatggacaaacacaacctggaggaggaggagccggaggactatgagctgctgcagattctctcagatgaccggagtaagtcagaagaccagagggcgatggcagagggggcaggtccacaccactccccagccccaggttggaagcctttggccccagaaaattcaccagcagagtgtgggtagacactgtggacagggcagccctggctgcccccattgtctgcttgctgtccccagcaaccactggacctccccagtgtgtgcccttccctaggcgtgaacaggcagttcaaagctcacatcagtgaggagcaaagagaaaaggcatttttcactgggacaggttagccacgtggcccactggaagggacgctttctggctaagacaagaaaacatgtgctctacaaagaatggtgacagctgtggaccaaagtgtcaagtgttaaaatccatgagtgtgtgattctaaaagcagaacaggctactaggaggccaactcagtattctagaaactgggaaagtgtcaagaaccagtgcaggctcagagtggggtatcctgggcctggagacgctgggcaagctccttaagccctctgtgcttgtcttctcatcccccaaatggaaatgaaagtagccagtgtgttcatcatatatgtaaaaatctatatgtatgtatatatgtgtatatatatgcatgtatatgtgtgtgtatatatatgcatgtatatgtgtgtgtatatatatgcatgtatatataaagcatctatgtgcaccataaaagttaactataaatactatcatcgctgttttctttccagtgagctgaacaccacctcccaccattagcccagacagtaagcaatgactcctgtgatccctagaagttacagtctaaatcctctggcagcttcttgcaccatttcggttaggtgggcagggtaggcgggacccccatcttacagaaaaggaagactgaggcctagagaggttaaagatgacgaaaagccacacgatgtcggcaggagcacaaatcgagcccagctctggtttatagcaggctgtgggccagaggagatggtgggaaatggagccaaaaggaagtgcttgccgggtgccagggttcaaggagtacaggcctccctggaacgggcgccagagccctggggcaggcctgtcctttcctggtccttggatcccttgtcctgagtagggcaggattctgggaggtgacctggattctagaaagcctgttccaggtgggcagccagcactgcagtatgggcaggacggggtgaccctctgccagctcaggccaagccggggggttctggagtcagtccctgtttaaacaagagtcatcaggttttgtgaggacctcagcagagtctgtcctcaggcaggagtcattgagaggggtccttggagttctggagctgtattggaggggatctgaggtctgtggctcaagacagtccttgtatgggctctcaagcggtaggggtatcctgcagggcccccaggagcatccctgatcacccctctgcccctccccaccagagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 128 - DNA, 5097 bp, Homo sapiens
gtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtgggggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggcttttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaactaaaggctttttgggggtcacagccacagagtggagttttattgcttctttgcctctccatgaatggccaatttggaaaagcagagatgggctttcagcagaatatcaaccaatacatttttcacatgcaaaactcatcaccagttgcctttttctaacttaatggacattttgttggtgttggtgcaagggcaataggatgtaaatttgtatataatctaatgtcttcattattaattgaatagtacatgttaacattttaatctatttaaatttactttgaaatatatacatacatatgaatgaaaggttgttacagagcctcaaagctgttgcagactatcccaagagaaaggatctggcacaaaggaatctgcctttcctccgtctcaagtctcccacccttgactggttgggatttgctcgtccagcctctagacacttcccaaagcaagactggacacatgccgagggcgttgcggatagtgcctcaccattgcccaccctgctgcccaactcctgtgagagaaaaaccaatcaatgtttacaaaatggaaaaggacacagcatgtcctttgaactccctaagtaaggcccacagttcttgatgcagagaaccaaagtgaatcatagaaaagcttttgctaacagtccgctttccaggaggcaaacttgtgtttatccaaacctgatccccatgatggggacttttctagagcaccccaaatgtcatggggagagagggactctttctgctccctcagagctactcttcacttgtccctgcttccggcaccaagttcataatagagatcttctggccagagaatcgggagaggagaggcctgatggggcagagctggacgaagtctgctaagagagatggaggctgtggcggactccttccaactcacgatttatcctcagctcagagtgtattttgaatatgagcaaatgtttattcaatcttcaagaagtatcaagtccatccaggcgcggtggcttacacctgtaatcccaggctttgggaggccgaggcagccggatcatgaggtcaggagatcgagaccatcctggctaacacggtgaaaccccatctctgtattttgtatttgtaaaaatacaaaaaattacctgagcgtggtggcacgcacctgtagtcccggctactcaggaggctgaggcaggagaatcacttgaacccgggaggcggaggttgcagtgagccaagatcatgccgctgcactccagcctgggcgacagagcaagactccatctc

SEQ ID NO: 129 - DNA, 5591 bp, Homo sapiens
gtaattctattggtacacccttggatcccaaatacattgatattgtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaggggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttatctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcaatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaag

SEQ ID NO: 130 - DNA, 4217 bp, Homo sapiens
aaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcctaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccaaccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagttgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctag

SEQ ID NO: 131 - DNA, 4153 bp, Homo sapiens
gtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacaggttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtggggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgt

SEQ ID NO: 132 - DNA, 3716 bp, Homo sapiens
agaaggccatcgcccagagtggcaccgccatttccagctggtctgtcaactaccagccgctcaagtacacgcggctgctggcagccaaggtgggctgtgaccgagaggacagtgctgaagctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctcttcaccaccaccacgcgcctgcctccctacgccacgcgctggccgcctcgtccccccgctggcgccccgggcacacgccggcccccgccgcctgccaccctgcctcccgagcccgagcccgagcccggcccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttggcccccggggccctgaccctgctgcccagtggcctggggccaccgccacccccaccgcccccctcccttcatcccttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggatgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgtt

SEQ ID NO: 133 - DNA, 4044 bp, Homo sapiens
tgcaggtctgtgaaagaataggtaaataaattgaaagtaagggctgagaaatttttgtagcaatttgacattgttataatgtccaatttttctaatattttatttttattgtatcttacgaaatatccatatgcaatggattcgaaataaagaaaaatctggtccttcatcagaactaggaaagcactgatttaaacatttggtcagacattttaaattgaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttct

SEQ ID NO: 134 - DNA, 4052 bp, Homo sapiens
ggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatcccggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttct

SEQ ID NO: 135 - DNA, 4654 bp, Homo sapiens
gcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatt

SEQ ID NO: 136 - DNA, 5164 bp, Homo sapiens
catttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctataaagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttcataaagtttgattggaacataccatgctcgtttgtttacatatcatctgcagctgttttttgtttttaatatggaacgcttcacgaatttgcatgtcatccttgcgcagggaccattctgatcttctctgtaccattccagttttttagtatatgtgctgctgaagtgaggactgcagctgctttcttgaacaatagcagagttgagtggttgcaacacacactgaatgtgactgtcatcacttcacactgctgtttgacacatcacaaatcactgatgtggttgtaacgacagcattttgagtgccatgtatatcacatgaacccacattttattttttattaccagagcatatctattatagcaaaacaagaaaagtggactttgttgttatttttaaagtacagtagggtgtgaattattttgatgttgaattagacgacaaagcatctatatagctaagctaaaagaataaccattgacattaccagacaaaccactcatcacagtattcccaactcacaggcaagcaactgttagaaaaattagaaaatttaaaatggaaataacaaagcagaatttcttcgcaaaatgaaaatgaggctgcaacaacagtaagtctctaagtcaatcatttgttagccaagcaaagccatttattgatggtgtgaattaattatgtttggatgcagcagctgaatatatccagagaaaataaacttaagattactggcctttggcaagaacagttgcttaaagagttaaggacattgaaagcgacataaatagtcactttaaaaaggaaatgattctggatggttctttgactctatttttatttttacttagagacagggtcttgctctgttgcccaggctggagtgtagagacacagttacacctcaatgtaaccttgaactcctaggcttgagatcttcccatctcggcttcccaatgtgtgaaggttacaggtgtgagcccttatatgtggccctcgtgaatggtttagcactatccccttggtggtgtccttacgataatgagttatgagatcttgttgtttcaaagtatgtggcactcgccccccacactctcttgctcctgccttcgccatgtgaagtgccttctcctattttgccttctaccatgagtaaaagcttcctgaggcttccccagaagcagatgccagtgctatgcttcctatagcctggagaactgtgagccaattatacctcttttcttataaattacccagtatcaagtatttctttatagcaatgcaagaatggcctaaaacacaaggcaaaacaactttgatatggtacagtcattttgacaatcgatatttgaatcacaatatttgatgacaatatccttacacatttgtcatactatcaaagagaaagaaacaagatttccattcccacaaattttagtgagtatattttctgagttcagcatttttagggacctaggtgcaagtgcaaaggaaatttccctgtttcaaaatctatttaactgcaattgaggtgattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtgtttgggggaaggggtatgtgtcactaatagaatatctctgaagctggattgatacggggaaaacatctttcccttctagttttgagagacttcctcttggctcccaggaggagggatttcctgactttgacacacatggccaccttggcacaaaagccttgtggtatggaaaaacaaattcgtttttatgtcttcttttccctttccatctttcagcatagacttaacccttaagcccagacatctgttgggacctgacccccggtcattggttaccagtgtgtctggcaatctggactttccagtgatgccactgagatggcacctgtcaaaagagcagtggttccatttctagattatggatcttcggataaattctgccattttcatttcacttcctgaaagtcagggttggcttgtgaaaagttgttaaacaacatgctaaatgtgaaatgttaaccctctaaactttccctgttcagagcatcagatgaggacttcattgggttttatagtggctgatttttggtagtccattgaagaagagagtttgaaagttgtatactgttaatgactgtctgcccatgtcctgcctgaaataccatgattgtttatggaaagtatctttaataaagctggatacagtttgaaag

SEQ ID NO: 137 - DNA, 5480 bp, Homo sapiens
gtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaatggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacacatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcccgcttctactaaaaaaaaaagagcacaaaagaaaaactaaattattgaaaaatt

SEQ ID NO: 138 - DNA, 4655 bp, Homo sapiens
cccgatcagcaagtggagactgggaaatccccctctttatctggagcctctgccaagcctgcccctcagtcgagtgaaaacgctggtacttcagatttagaactacctgtcagtcaaaggagtcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtg

SEQ ID NO: 139 - DNA, 4282 bp, Homo sapiens
gagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccaggaagcaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttactttgatttatttgattgaaccctggaagtattatttttaccagtcccacatttaaagacctagtaatcttgatggaattggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacctggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatataatctttttatatatataaaaaatcttttttataaattttattttaaaaatcttttaaaaaagatttttatatatatataaagactatatatttatatatagtcttttctgttcataatggcattagtctctgagtacattttatattatctttgttgctacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaaataggacttggaaaatgtggtatattctaagtcaagatgctatgaagttgttatagtttaagggacattcttaagaaggaattacttaagtacattactcttctcattttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgctt

SEQ ID NO: 140 - DNA, 5443 bp, Homo sapiens
ctggagcagctgaaaccggtttgagcgtggctgcttcctgccgctcgacgccgcggcaggccgcctgggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattctcatattagtattctttattgtatatcatgcatgtaatttatttagaaatgtaggtcttactaaatgtatatgcatgtatttcagattatactaggatttcttggattagaagctgattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaac

SEQ ID NO: 141 - DNA, 3907 bp, Homo sapiens
ccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggtcctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 142 - DNA, 3063 bp, Homo sapiens
ggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaagg

SEQ ID NO: 143 - DNA, 4434 bp, Homo sapiens
gcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccagggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatggcagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtc

SEQ ID NO: 144 - DNA, 5536 bp, Homo sapiens
agcaaacaaactcttctagagatatttttggtaaccacagtgaataaaagattgactgttagtaactattttcatttactagactgccctgaactactcatctgtgagttgagtattttttttttaagtgaaagcatgtttattaagaaaataaaggaataggctgggtgcggtggctcacccctgtaatcccagcactttgggaggccaaggtgggtggatcacctgaagtcaggagttcaagaccagccgggccaacatggtgaaaccccgtctctaccaaaaatgcaaaaattaggtaggcgtggtggcaggtgcctgtagtcccagctactcgggaggctgaggcaggagaattacttgaacccaagaggtggaggttgcagtgagccgagatcgggcactccagcctgggcgacagagcaagattctgtctcaaaaaaaaaagaaacaaagaaagaaagtaaagcaataaagaatggctacttcataggcagagcagctgagtattttcttttcccagcaacttttatctcccgaatagaaattctttctaatcccacttactatttggaattctaaatccaacattgctttcccagagatccatgttatcaagatttgcttgtattagttaagagcgattgcttattatctatacagcccttgaaattacattgttgtgaagtcaggctgctgttttagggctaagtaaggttttctgaaaaagaggcaatggtgcaaagacagctggaaagacagagttaaacataccttttaaagtggatcaattttatgtaaccagagtatgatctttctgttttatgtgtttattggaagagttgtcacttaaagtgatattcctcaaatagctaaaaatgtcctgggttttctagatagaaaatatctctaagttgtacttattaaaatgtgacttggggaattttaaattatattcagtggaagtatatttgcccagctttatttttgttcgggtaatttatttctcaaaattttggaggtgaggtctttattgatttgtgtgtgtgaaaaacaagacaaaacacacccactatgaggatcctttaaaaaaaaagctttcttgttatccagataacacactttaatcgtacgacggaaatggatacatttaacatgacaaaaaatagcaaaatcctctgctcatggaaagatgatttccaaaccctcttgtcttacagaagaaaacatttggttgactaagaactgacatggtctgctcatagggattcttagcatttttaacatcatccctgtttgactgcttctttttctacattctcatcttctaacttttttctagggctgctctttttagtaaagctaaacaaaacctggcgtcctacagccttactaacctttgttaatccgcctgctcgtcacatctttgtatggcatctgtgctcactcatgggggaaagagattctggaagaagcaacagcaataaccaaggcaaatgtggggaagtgtctgcatgggttgttagcatgatgtgtggggcctaggttttacttcattttcttcgaatagtgaggtcgttaagtcacgccatttgaataattttgtatgaccatagggtgacatactcatccctgttgtcaattctcctaagaaatttggtggcaaatttcatcacttaagccagaaagtggaaatttggattagggatgccaaataagcaaatctttatattgatagaaatgtacataggcgtatgtcttaatagacttccacattattgaggggttttttttggttttgttttgttttttagtttttttggtcttatttttaaatttggttaaggcttttttgcttgctttttcttcgatttaattttccttttttacattttaattttggttattttggggccattttttgattttgtttttccaaaggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtcttt

SEQ ID NO: 145 - DNA, 4114 bp, Homo sapiens
gggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagacttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggaccgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcagataatccacctgcttctgcctcccaaagtgctgggattacaggcgtgagccaccatgcccggctgggcttgtatcttttagcttgtgttagtaaaaggattctagaaaattatgaagtccagattcaaagggatctctgttaattacccactgacaggcattatgacctaacaggaggttggtagcagtagatccaagcatgcatgttgcctggcctgtagattggccttatcaggtttctgggtgcctctgccttaagatcctgaaggcaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacggaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacagg

SEQ ID NO: 146 - DNA, 3692 bp, Homo sapiens
cgaggaggaagcagcaggcgccccggcgcgcagcagcctatgtttccgaagagttaaaggctgctgccctggtggacgaaggtttagacccagaggagcatacggcagatggagagccctcggccaagtacatgtgcccggagaaggagctcgccagggcctgccccagctaccagaactccccggccgccgagttttcctgccatgaaatggacagcgagtcacacatcagtgagaccagtgaccgaatggctgactttgaaagcggctccatcaagaacgaagaggagaccaaggaggtcacggtcccactggaagacacgactgtgtcggatagcctggagcagatgaaggccgtgtacaacaacttcctctccaactcctactggtccaacctcaacctcaacctgcaccagccctcctcggagaagaacaacggcagcagcagcagcagcagtagcagcagcagcagctgtggcagcgggagcttcgactggcaccagagcgccatggctaagacgctgcagcaggtgtcacagagccgcatgctcccggagcccagcctcttcagcaccgtgcagctgtaccggcagagcagcaagctctatggctccatcttcacgggggccagcaagttccgctgtaaggactgcagcgctgcctacgacaccctggtggagttgacagtgcacatgaacgagacggggcattaccgcgacgacaaccatgagaccgataacaacaaccccaagcgctggtccaagcctcgcaaacgctccttgctggaaatggaagggaaggaagacgcccagaaggtgctgaagtgcatgtactgtggccactcctttgagtccctgcaggatttgagtgtccatatgatcaaaacaaaacactaccaaaaagtgcctctgaaggaacccgtcactcctgtcgccgccaaaatcatccctgccactcggaagaaagcttccctggagctggagctccccagctccccagattccacaggtggaacccccaaagccaccatctcagacaccaacgatgcacttcagaagaactccaacccttacatcacgccaaataatcggtacggccaccagaatggggccagctatgcatggcactttgaggcccggaagtcgcagatcctgaagtgcatggagtgtgggagctcgcatgacaccctgcaggagctcactgcccacatgatggtcactggccacttcatcaaggtcaccaactctgctatgaaaaaggggaagcccattgtggagacgcctgtcacacctaccatcacaaccctgctggatgagaaggtccagtccgtgcccctggcagccaccaccttcacgtccccctccaatacacctgccagcatctccccaaaactgaatgtggaggtcaagaaggaagtcgacaaggagaaagcggtcactgacgagaaacctaagcaaaaagacaagcctggcgaagaagaggagaagtgtgacatctcttccaaataccattacttgactgaaaatgacttagaagagagtcccaagggggggcttgatatcctcaaatccttggaaaacacagtgacatccgcaatcaacaaggcccagaacggcactcctagctgggggggctatcccagcatccatgccgcctaccaacttcccaacatgatgaagttgtccctgggctcgtcggggaagagcacgcccctgaaacccatgtttggcaacagtgagattgtctccccgacgaaaaaccagaccctggtctctccacccagcagccagacgtcccccatgcccaagacaaactttcatgccatggaggagctggtgaaaaaggtcactgagaaagttgccaaagtggaggagaagatgaaggagccggatgggaagctttccccgcccaagcgggccactccctccccatgtagcagcgaagtcggggaacccatcaagatggaggcatccagcgatgggggcttccgcagccaggagaacagccccagccccccgcgggatgggtgcaaggatgggagccccctcgctgagccggtggagaatggcaaggagctggtgaagcccctagccagcagtttgagtggcagcacggccatcatcaccgaccacccgcctgaacagccttttgttaaccctttgagcgccctgcagtcagtcatgaacattcacctgggcaaggccgccaagccctccctgcctgccctggaccccatgagcatgcttttcaagatgagcaacagcctggcggagaaggccgctgtggccaccccgccgcccctgcagtccaagaaggcagaccacctcgaccgctatttctaccacgtcaacaacgaccagcccatagacttgacaaaagggaagagtgacaaaggctgctccttgggttcagtgcttctgtcacccacgtccacagccccggcaacctcctcatccacggtgacaacggcaaagacatctgccgtcgtatcattcatgtcaaactcgccgctacgcgagaatgccttgtcagatatatccgatatgctgaagaacttgacagagagccacacgtcaaaatcctccactccttccagcatctccgagaagtctgacattgacggggccactctggaggaggctgaggagtcgacgcccgcccagaagaggaagggccgccagtcaaactggaacccccagcacctcctgatcctccaggcccagtttgccgccagcctccggcagacctcagaagggaagtacatcatgtcagacctgagcccccaggagcggatgcatatctccaggttcaccgggctgtccatgaccaccatcagccactggctggccaacgtgaaataccagcttcgaaggacaggtggaacaaagttcctcaaaaacttggacactggccaccccgtcttcttttgtaacgattgtgcgtcccaaatcaggactccttccacgtacatcagtcacctagagtcacacttaggcttccggctacgggacttatccaaactgtccaccgaacagattaacagtcagatagcacaaaccaagtcaccgtcagaaaaaatggtgacgtcctcccccgaggaagacctggggacttcctatcagtgcaaactttgcaatcggacctttgccagcaagcacgctgttaaacttcaccttagcaaaacacacgggaaatctccggaagaccaccttctgtatgtctctgagttagagaagcagtagcatttgcttttgatagaaaggactgcagtttgctttgagggaaactgtggaaggcaccttcaggccccctctgacttgttgttcttggcacatgttcttattttaactgcagagaatcactctgggctggactgttttgtataactgtacagtgtttaatagaggtgcataatcagctgttgttactggtaaaatatgaaggttaaaatgcagtggtaagtgtttggaactttgtgtaaacgggatttagttgtgagcatcctcccgatgcttcaagctgcatgcattaacagacagtttaattaagcatttataacggaatcaggcacaccttttccacgagactcgagtgtgctggcatttctcaccctttcatctttagccctctgagtactttgaagcacttttgcattaatttggttaaaaaataaaataaaataataataatgt

SEQ ID NO: 147 - DNA, 3869 bp, Homo sapiens
gctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgtcgagagcggcccgactgcctggacacggtcctggcccgggaggccgatttctgctttcgccagcgtcgctacctggagagcgcacgctgctatgccctgacccagagctactttgaggagattgccctcaagttcctggaggcccgacaggaggaggctctggctgagttcctgcagcgaaaactggccagtttgaagccagccgaacgtacccaggccacactgctgaccacctggctgacagagctctacctgagccggcttggggctctgcagggcgacccagaggccctgactctctaccgagaaaccaaggaatgctttcgaaccttcctcagcagcccccgccacaaagagtggctctttgccagccgggcctctatccatgagctgctcgccagtcatggggacacagaacacatggtgtactttgcagtgatcatgcaggactatgagcgggtggtggcttaccactgtcagcacgaggcctacgaggaggccctggccgtgctcgcccgccaccgtgacccccagctcttctacaagttctcacccatcctcatccgtcacatcccccgccagcttgtagatgcctggattgagatgggcagccggctggatgctcgtcagctcattcctgccctggtgaactacagccagggtggtgaggtccagcaggtgagccaggccatccgctacatggagttctgcgtgaacgtgctgggggagactgagcaggccatccacaactacctgctgtcactgtatgcccgtggccggccggactcactactggcctatctggagcaggctggggccagcccccaccgggtgcattacgacctcaagtatgcgctgcggctctgcgccgagcatggccaccaccgcgcttgtgtccatgtctacaaggtcctagagctgtatgaggaggccgtggacctggccctgcaggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgc

SEQ ID NO: 148 - DNA, 3174 bp, Homo sapiens
ggctcaccgacaacttcatcgccgccgtgcgccgccgagacttcgccaacatgaccagcctggtgcacctcactctctcccggaacaccatcggccaggtggcagctggcgccttcgccgacctgcgtgccctccgggccctgcacctggacagcaaccgcctggcggaggtgcgcggcgaccagctccgcggcctgggcaacctccgccacctgatccttggaaacaaccagatccgccgggtggagtcggcggcctttgacgccttcctgtccaccgtggaggacctggatctgtcctacaacaacctggaggccctgccgtgggaggcggtgggccagatggtgaacctaaacaccctcacgctggaccacaacctcatcgaccacatcgcggaggggaccttcgtgcagcttcacaagctggtccgtctggacatgacctccaaccgcctgcataaactcccgcccgacgggctcttcctgaggtcgcagggcaccgggcccaagccgcccaccccgctgaccgtcagcttcggcggcaaccccctgcactgcaactgcgagctgctctggctgcggcggctgacccgcgaggacgacttagagacctgcgccacgcccgaacacctcaccgaccgctacttctggtccatccccgaggaggagttcctgtgtgagcccccgctgatcacacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccgagctcacctcgaactccgtgctcatccgctggccagcccagaggcctgtgcccggaatacgcatgtaccaggttcagtacaacagttccgttgatgactccctcgtctacaggatgatcccgtccaccagtcagaccttcctggtgaatgacctggcggcgggccgtgcctacgacttgtgcgtgctggcggtctacgacgacggggccacagcgctgccggcaacgcgagtggtgggctgtgtacagttcaccaccgctggggatccggcgccctgccgcccgctgagggcccatttcttgggcggcaccatgatcatcgccatcgggggcgtcatcgtcgcctcggtcctcgtcttcatcgttctgctcatgatccgctataaggtgtatggcgacggggacagccgccgcgtcaagggctccaggtcgctcccgcgggtcagccacgtgtgctcgcagaccaacggcgcaggcacaggcgcggcacaggccccggccctgccggcccaggaccactacgaggcgctgcgcgaggtggagtcccaggctgcccccgccgtcgccgtcgaggccaaggccatggaggccgagacggcatccgcggagccggaggtggtccttggacgttctctgggcggctcggccacctcgctgtgcctgctgccatccgaggaaacttccggggaggagtctcgggccgcggtgggccctcgaaggagccgatccggcgccctggagccaccaacctcggcgccccctactctagctctagttcctgggggagccgcggcccggccgaggccgcagcagcgctattcgttcgacggggactacggggcactattccagagccacagttacccgcgccgcgcccggcggacaaagcgccaccggtccacgccgcacctggacggggctggagggggcgcggccggggaggatggagacctggggctgggctccgccagggcgtgcctggctttcaccagcaccgagtggatgctggagagtaccgtgtgagcggcgggcgggcgccgggacgcctgggtgccgcagaccaaacgcccagccgcacggacgctggggcgggactgggagaaagcgcagcgccaagacattggaccagagtggagacgcgcccttgtccccgggagggggcggggcagcctcgggctgcggctcgaggccacgcccccgtgcccagggcggggttcggggaccggctgccggcctcccttcccctatggactcctcgacccccctcctacccctcccctcgcgcgctcgcggacctcgctggagccggtgccttacacagcgaagcgcggggaggggcagggccccctgacactgcagcactgagacacgagccccctcccccagcccgtcacccggggccggggcgaggggcccatttcttgtatctggctggactagatcctattctgtcccgcggcggcctccaaagcctcccaccccaccccacgcacattcctggtccggtcgggtctggcttggggtccccctttctctgtttccctcgtttgtctctatcccgccctcttgtcgtctctctgtagtgcctgtctttccctatttgcctctcctttctctctgtcctgtcgtctcttgtccctcggccctccctggttttgtctagtctccctgtctctcctgatttcttctctttactcattctcccgggcaggtcccactggaaggaccagactctcccaaataaatccccacacgaacaaaatccaaaaccaaatccccctccctaccggagccgggaccctccgccgcagcagaattaaacttttttctgtgtctgaggccctgctgacctgtgtgtgtgtctgtatgtgtgtccgcgtgtagtgtgtgtgtgtgtgtgtgtgtgtgtgtgtgtgtgtgtgtgtgtgttgggggagggtgacctagattgcagcataaggactctaagtgagactgaaggaagatgggaagatgactaactggggccggaggagactggcagacaggcttttatcctctgagagacttagaggtggggaataatcacaaaaataaaatgatcataatagct

SEQ ID NO: 149 - DNA, 6250 bp, Homo sapiens
gttgcagtgagccgagatcgcgccactgcactccagcctgggcgacggagcgagactttgtctcaagattactctaaacagaaacaagagtgaaataaatttgtggagttaataataaaaatgttattctctgtggtatgttttcttttcttttgtttttttgggacggggtcttgctctgttgcccaggctggagtgcagtggcgccatcttggctcactgcggcctctgcctcccgggttcgagcgattctcctgcctcgggcccctgagtggctgggattacaggcacgtgccaccacgcctagctaatttttatatttttagtagagacggggtttcgccatgttggtcatgttggtctcgaactcctgacctcatgatctgccccctgccggcctcccacagtgctgggattgcaggcgtgagccaccgcgcccggcctgtattttttcatttcatagaatttccagataaaagtcagagtcaactagttttataatactgaaaagttttgcaaatacaagcatgtcacttaatgatggggatgtgttctgagaaatgtgtcattaggtgattccgtcattgtgcaaatgtcatagagtatacttacataaacctaggtggtatgtagcctatatgatatatgtggcttatatgatataccctattgctcctaggctgcaaacctgtatagcatgttactatcctgaagtcaatgggcaattgtaacacaatggcaagtatttgtgtattgaaacataagggtatagtaaaaatatggtactattaatacaactgtatgggactaccattgtatatgcggtccatcattggccaaactttctttatggtggcacaagactacataataaatggtaaagtaaccagacttggagatggggaggagggagaagaatgccaaatgtatgtttcctcccacagactagcaggcatctagtatcaggcaacatacttatacaatcatttcctactcctgtctcacacttgccagaatctggatttaattttttttttttattgttagaccagtaatgcagttttcatattttgtataacaaaaaagttgtaggacttttccttcttactgtgaaaatatgactcattaaatacataacttttagtattggccatttgtattcttatactcttagtcacaaagataactacgttttacaaagtcgaaaggttaataatagcagctagcatgaattcagagcttgctatgtattgagcactgggtttaaacacatatgctctattttattaagtccttatagtaggaaagtgaagaatacactagtcactgaagttccttcagtgctcaagactcaagtgcactatagcaagacaaacaccaggaaacatgtaactctgcttcgaatactttagcaagtgaatggcccagtttgggaaagcaagacaaacactggatccataatggctttttacacctgattggaatgcagaaaaaatggaaccactaactactaatattatctttgccagcaggtgagcagtacatacctgacttcagaggattttattgaaaccaatagatgatggttaataaaaacaaatatcctcagctttccttcttttacttgtcatctgacaaccactatttagctaaaactaaaatggattagagatacaagatgatgaataacaattattaacttttgtgagcatataatgtgagtcagctactacactaagaactttacatagattcccttaattttctcaataatcctatgagaactgtccttgtatgagcaaccccattttatagctgaagatacttgaggcttcaagaggttatataaacatgttcatggtcaacagttattaagcagtgagtgacattctcacgagattaatgagatcatctgtgtgagatacaaatacatctattgtgtatgtttgtgtttttaatggagaccaatggtatgacagaatgaagtccttttatcagtcagtcaagatctgatgtggctattcaaatataggcaaaactgatgttttccttttttagttaagttaaatgtactatttaaataactgtgaatatttagaatattcacagaattgtgcaaccatcaccacaatctttagaatattttcatcatctcaaaaagatactttgtagcctttagcacccttcccactgtacccccccccatacccctggccataggcaactactaaattactttctgtccctgcaggttgtcctattctggatactttgtatatgtggaatcataaaataggtgatcttttatgactggcatctttcaagcatgtttttgatattttcatccatgttgtaggatattaaattaactttttgcataggaataactagctagaaaagcatgggctgaatatgtctgcagaatgtagcatttagaaaagaaagacttccaggagacaaatgaggtagtaactaaaatgtaaataactaaaaattagctttgagtctttaataaactacctttcatgttttgctttcactaggaatgaacttttaattttttggagctataaatacatgtagtttctaaagacatctttgtttttaaagaaaagacatctgcaggctttttcttagtgttcctattaagtatgtatgagtgtgtgcatttgtgtgtgtgtgtgtgcatgtttagtgactttacatgtgtatacatacaaatgtacacagtcatatatgactagtggtacatggaatctcaatttaattgtaaaagtgaaggagttctaaaactagttttagtatagtaagtgggatatagtaagaatgtcctacaatttaaaagcttatttggttatcttcaatggattttgaatgtattcaatactagatttgcgagtgactatgcctttttagtaaacaaaagaaaggctataatgtagaaagtatatggaataagcataacatctgtcctaatctaattttcaggcacatctccagacttcaatttggctgaaataattcatgccacggacctgtgcacatgcctggaattgagagacacagttaaaagactccaagttgctttctgccttttgaaaactcctgaaaaccatccctctggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggatggggttcccctgtgcttttaccagtagcatgaccccttctgaagccatccgtagaaagtactttgtcctccaaaaagctaacatacggttttgaagcagcattgaaacttttgtagcaatctggtctatagacttttaactcaagaagctaaggctagacttgttaccttcgttgaatgatgttagttgactgtactgtaatgttgtatcaactgaattgaatgtttgcctttaaacaatgaattttctttttctttccttttttttttttgttgtaatagttaaagaggcttagaacaagctaacaggcaatagaaatatgtatatcagattttttaatgtaacaaactacatgttaattgttatcttattctttttatctttagtagacacttttaaaagaaaagacaattttgttgtgtttaactcaccaacacgtggtgtataatgaagacagaactataataaattagttttgttctgattttttagaacacttgc

SEQ ID NO: 150 - DNA, 5283 bp, Homo sapiens
tggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatataggacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccg

SEQ ID NO: 151 - DNA, 5294 bp, Homo sapiens
ggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcagaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 152 - DNA, 2794 bp, Homo sapiens
acttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatgatgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcgttcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatataggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcttgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcacggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcggcagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagccctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactgttgagaaaggcatgtgttgtttaagccattgagattttagagctttttgtcactatctgtcaagactgatactactggggcttttcctattgatttgggagttctttacatattaaaaaaatgtgagcctt

SEQ ID NO: 153 - DNA, 2614 bp, Homo sapiens
ctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgagctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttttgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagtgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagcc

SEQ ID NO: 154 - DNA, 3496 bp, Homo sapiens
gaaatcgagcaggagcgggtgaagtcagcgggggcctggatcatccacccctacagcgacttccggttttactgggacctgatcatgctgctgctgatggtggggaacctcatcgtcctgcctgtgggcatcaccttcttcaaggaggagaactccccgccttggatcgtcttcaacgtattgtctgatactttcttcctactggatctggtgctcaacttccgaacgggcatcgtggtggaggagggtgctgagatcctgctggcaccgcgggccatccgcacgcgctacctgcgcacctggttcctggttgacctcatctcttctatccctgtggattacatcttcctagtggtggagctggagccacggttggacgctgaggtctacaaaacggcacgggccctacgcatcgttcgcttcaccaagatcctaagcctgctgaggctgctccgcctctcccgcctcatccgctacatacaccagtgggaggagatctttcacatgacctatgacctggccagtgctgtggttcgcatcttcaacctcattgggatgatgctgctgctatgtcactgggatggctgtctgcagttcctggtgcccatgctgcaggacttccctcccgactgctgggtctccatcaaccacatggtgaaccactcgtggggccgccagtattcccatgccctgttcaaggccatgagccacatgctgtgcattggctatgggcagcaggcacctgtaggcatgcccgacgtctggctcaccatgctcagcatgatcgtaggtgccacatgctacgccatgttcatcggccatgccacggcactcatccagtccctggactcttcccggcgtcagtaccaggagaagtacaagcaggtggagcagtacatgtccttccacaagctgccagcagacacgcggcagcgcatccacgagtactatgagcaccgctaccagggcaagatgttcgatgaggaaagcatcctgggcgagctgagcgagccgcttcgcgaggagatcattaacttcacctgtcggggcctggtggcccacatgccgctgtttgcccatgccgaccccagcttcgtcactgcagttctcaccaagctgcgctttgaggtcttccagccgggggatctcgtggtgcgtgagggctccgtggggaggaagatgtacttcatccagcatgggctgctcagtgtgctggcccgcggcgcccgggacacacgcctcaccgatggatcctactttggggagatctgcctgctaactaggggccggcgcacagccagtgttcgggctgacacctactgccgcctttactcactcagcgtggaccatttcaatgctgtgcttgaggagttccccatgatgcgccgggcctttgagactgtggccatggatcggctgctccgcatcggcaagaagaattccatactgcagcggaagcgctccgagccaagtccaggcagcagtggtggcatcatggagcagcacttggtgcaacatgacagagacatggctcggggtgttcggggtcgggccccgagcacaggagctcagcttagtggaaagccagtactgtgggagccactggtacatgcgccccttcaggcagctgctgtgacctccaatgtggccattgccctgactcatcagcggggccctctgcccctctcccctgactctccagccaccctccttgctcgctctgcttggcgctcagcaggctctccagcttccccgctggtgcccgtccgagctggcccatgggcatccacctcccgcctgcccgccccacctgcccgaaccctgcacgccagcctatcccgggcagggcgctcccaggtctccctgctgggtccccctccaggaggaggtggacggcggctaggacctcggggccgcccactctcagcctcccaaccctctctgcctcagcgggcaacaggcgatggctctcctgggcgtaagggatcaggaagtgagcggctgcctccctcagggctcctggccaaacctccaaggacagcccagccccccaggccaccagtgcctgagccagccacaccccggggtctccagctttctgccaacatgtaaaacctttgagtacatccagccttagttcttggggtgcagtagtatgtacccaagggcagatgcctcttggggaaggccatggggacctgaaacattgccccatggaaatgtcgaccctgtgcggacattccgcatactgccatgaagacggtctctgtgtcctcagctcaagaatcctgtagcttgtcccatcataatccattcacccgttcatcatgtgtactgagcagctaccatgttcaaggtaatatgccaggcgctgtatgtctccactgccaagtagaagtgactcaaaaccctctgacaaggatattcccttggctatggtcctgccaggtgcaggcccaggcccatgaccccacctttactaagcacaagtacttgccactgccatcactgccaagtaactagatgtctctgtttccctgccaatgatcctgcaggttctgcccggtctggttatcttcctgttcctgtagcatagccaggcactgccagtcacctgtgcccccattgctgtcagcagatgtcttgggtcctgagtgtgggtatccacttttacccgctcactgccacctgtggacactctgtgtctaccctctgagtgggaacatacttctaagttccctgcagtctctgtcctgtggtagaccatctttttgtaaactgcgagcttcctcttccctgtaccctctgccccagtcgtgaccccctaaaagttaaggggtagttggcacctccttattaatatgccagcctagatcccccccggtggaggggcaaatggctgaatccttgtgtgatatttttttcttcgcttgtttatttattcatttatttaattgtatttattcatttactaactttatgtgttaccaattaattttgtttacccattcctttatccatccctcccctccttttcaggtaaggagacaggaggagtaggaggaggcagggcctctccatgccagcctctgtggtccttgcccaaacccatcagcgcaatacttgaaccttctcccaggtaggggcaggaggagccacatgagagagggagaaggaccgcgtttacctttagagttttgttttgttttttccttctgagtttgctgttggtgcaggaataagggaaaggcccaaggtatccaagcctggggaagggcaggccagccagcacctctgccttctcagggacaagagtagtcctttaccaccctcactctgcctgtcccctctcctactctacagcattaaagactgtgggaccaggaccctaagtctcctttccttctgggtggggagttctggggttcttggtgtgtgggagaagttttataattgcttccaaacagctgggtttaaatataaaatagacacactc

SEQ ID NO: 155 - DNA, 3920 bp, Homo sapiens
gctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacactgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgt

SEQ ID NO: 156 - DNA, 5771 bp, Homo sapiens
aatggcctgtgagtcagaggggcagtggagtcggcggcgcggagccggggcggccccggggagggaccgtcgcagggaggggcgcggcagcggctggggggctgcgggcgccagggcccgctagtgttgcacacgaagctgaacagcgaagagcctagcagagcagggctcagcctgagccaccctttgtctgggttgggggcccgtggcagggaggaccggggaaccaaggggagggaccgggacgggacgggacggaagggaccggagcagcggccacctccgcggagccaatttgggagcggggtgagtgtgctagagggaaagagcaaatctccgaagctccagtatagtatggggcctgtcccaggctgtggggaggagaggagtgagaagggacctgggaggctgggcagggggtaagggatcgtccagaagaaggagtccaggagtcaggtgagtctgcctggcttagtttagagagtctgctaaggtctgctctctcccctctgaagatagagggctctaggctgggggccgaggggttggtaagagagaagaagtcgaccttcctacccacagtggtggtccgtgggaacagcccccctagcttgtgtggatgtatgtagggacaaaatagagagcagctggcagcagttctctttgcataggatgagggtggaaagcacatggataggaattcatcctgtcactctccttgatcatggtagaaatggaaatctttaatactgaagggaaggggagaatgagccttgaagctgatacctataccaatacccacctcacccacctcccaggcctcaaaagtgtctaaaggtacagacgtattctgggacttgttgtttttgctggccttgctccctcagcatgttgggagctgtagtccttgccagccacagcctggcacagctgtttgatgccagctgctgcccaccccctgaacgaagagtgaggcttggcctactctgccctgcccccctcccctgcagtcctgccccatgagtcagcttgaagccatggtctagagccagactggctgggtggcaggggagtgaatatagagcgtcttgttgacagggtgggaactgagagggctctggggttaataagcagatgccaggtatgctggggtcaagtagggcatcatgtcatcccctggcttccccagggcaaggggtcaagagggcaactgggatgacctggaagtggtggtgctagggaaaaggcccctcctgaatctgtatggcttgggtggaggaaagaagggtagaaattagtgcaggttgtaccttctgacaaggttggttgcaggtaggatagtgcaggttgcgattggtgttctgccctttccagccatcccgcccaccacagggaaccaggattttcttagggatcccaattcttaggagaatttggtgaaatgggatagtggggtacaatgatgggaacttggtgtaggagagcttttcagtccctgggtacaaatctctcctttctgcctgctccccacccccacctctgttcctgattttcccttgtacaattaatctctctgcttctctcatctgggaaatttttctctccactctcaggactgctgctcagatgtctgggacttgcattctactttttttgagccctgctgtgtgcttacccctgtacttggggttggatggaggggtgggacacagatctgtcctcaggaactctatggtcggtctagaagatgccttacccacaggagtgagcagaactgttagtgagcttacaggaagtagtaacactgccataggtgaggtctcagagaagggagagatgcttatggtctggggtggacagagcagactttctggaggagatggcatttgacctatccaaggaggaaaagtcttgggtaggcattcaaagggcacttcttgaaggggaaagagcaccgtgaatgtcagacagcaaaagagaaggctgaccctgggggcagttggctttcaacttgacattcccctcaccctagtatgggctggaatagttagtgaagaccatcttatgcaccagtggtttggggttttggtgttgggtgtgtgagcactgggggaggggcgtggagaggtactccctagttgcttccagctgactgactgctgcggccttatctctagtttgcagggccttgcgggagggccctggaaagtgccttctggcagtgaccccttccccttccccttcttgtttttggtcggatttgttgcctcttgttaaagagacaggctgctggaggcaatttggagttcagggctgaaaggccagctctgagctgacttgaaatttgtacctctgaggaccgctgatggggtataactgtgtgggagacctctgcccttagtgccctaggatggcacttgtccctttggagatagacatataagaaggagttgtgcaatttggtggctttgagtaagaaagctgaattcttcccctggccgcctctcagctgacacggtctcttggatcttgggggtctctcatcccttcctccatgtagggcaggagtcctcaaatggtggccctgacaagtagttattctacctcaactcacttgtcacatccttattatactgagccaagacctgcctctttgactccttaggtagcccaactctgccatctgtgccctggaccccaagcctaccctttctgttcctgaagagcctctcacatgggagaaggatgtcctggagtgtactattagcctataattggtgacaggccttaccgctggctccagtgatcctggcttacgtctgttcttctctcctcagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttg

SEQ ID NO: 157 - DNA, 1824 bp, Homo sapiens
gacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcgctggggagggccggtaggggaggggcccgggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgctcttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtaggagaggcagcgccgcaggaggcgggtgcccgtttgtcccaggcctgggcgtggtggaggaaggggtgctggaacaataaacggcactatccaaaaaaaaaaaaaaaaaa

SEQ ID NO: 158 - DNA, 6411 bp, Homo sapiens
gaattcgcggccggcggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgccctccaggatcagttcctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtggatcagtggaagaagtgttcagactacgacaagcactgtctgatgccgaaaatgaaataatgagattgagtagtttaaaccaggataacagtcttgctgaagacaatctgaaacttaaaatgcgtatcgaagttttagaaaaagagaagtcattactgagtcaagaaaaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagccgagatagaagaattggacagacagaatcaagaagctacaaagcacatgattttgataaaagctcagctatcaaaacaacaaaatgaaggagatagcatcatcagtaaactgaaacaagatctaaatgatgaaaaaaagagagttcatcaacttgaagatgataaaatggacattactaaagagttagatgtacagtttgttttgctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcgcttctgtctctcaggaaccgtaaagcagtatcgtctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgaccagggcggtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttggttcggcggccgcgaattc

SEQ ID NO: 159 - DNA, 405 bp, Homo sapiens
atgactaagctggaggaccacctggagggaatcatcaacatcttccaccagtactccgttcgggtggggcatttcgacaccctcaacaagcgtgagctgaagcagctgatcacaaaggaacttcccaaaaccctccagaacaccaaagatcaacctaccattgacaaaatattccaagacctggatgccgataaagacggagccgtcagctttgaggaattcgtagtcctggtgtccagggtgctgaaaacagcccacatagatatccacaaagagtaggaagctctttccagcaatgtccccaagaagacttacccttctcctccctgaggctgggttacccgagggaagagagaattaataaacgtactttggcaaagttcttagcaaaaaaaaaaaaaaaaa

SEQ ID NO: 160 - DNA, 1388 bp, Homo sapiens
ttcggcacgaggcacgcgcacgaactcagccaacgatttctgatagatttttgggagtttgaccagagatgcaaggggtgaaggagcgcttcctaccgttaggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtcctagcttactctgccaccactgcccggcaggaggaagttccccagcagacagtggccccacagcaacagaggcacagcttcaagggggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgttaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccagggactcctgccccagctgctgaagagacaatgaccaccagcccggggactcctgccccagctgctgaagagacaatgaccaccagcccggggactcctgccccagctgctgaagagacaatgaccaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgcaccccccaggaccctggtctcatcagtccctctcctggagctgggggtccacacatctcccagccaagtccaagagggcagggccagttcctcccatcttcaggcccagccaggccagggggcagtcggctcctcaactgggtgacaagggtgaggatgagaagtggtcacgggatttattcagccttggtcagagcacaaaaaaaaaaaaaaaa

SEQ ID NO: 161 - DNA, 2890 bp, Homo sapiens
gtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccaccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 162 - DNA, 3200 bp, Homo sapiens
ttcctgttcattggccatcggtcatggagaaggcgggctcagtggacgaacggctttctgggagctggggaatgcttgcgtacgtagtttcccagcgagccccgcgaggacttccggcgccgggagctcgcggcggaagtgggatctcctgggccgtagtgggcgttgtgtgtttcgggggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagctttcggctgcagcactgcgccaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagccgtggggtgagcagctggcttgccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatggtccagctccgtcggcactaccaccctgctccatcatcactacgtccagctccaatgcactggtgccccattccatcgggaataacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaagactccccctcagacctccaaagggcaacagaagagtattaataaacgtgaaaactt

SEQ ID NO: 163 - DNA, 954 bp, Homo sapiens
acagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttgaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 164 - DNA, 1874 bp, Homo sapiens
gacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtatcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaaaaaaaa

SEQ ID NO: 165 - DNA, 2883 bp, Homo sapiens
tcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggatgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcacctgcggccagctgatgagagtaacctttctccttcagaagttgtacagtggtccaaccacagggtgatggagtggttacgatctgtggacctggcagtgtatgcacccaatcttcgagggagtggagtccatggaggcctcattatcctggagccactcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcccggaattc

SEQ ID NO: 166 - DNA, 1623 bp, Homo sapiens
gttggatattatacaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttcatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaaaaaaaaaaaaaaaaaaaaaaaaa

SEQ ID NO: 167 - DNA, 1585 bp, Homo sapiens
gacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatacgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaaaaaaaaa

SEQ ID NO: 168 - DNA, 1818 bp, Homo sapiens
  misc_feature 24, 25, 29, 33, 36, 37, 38, 40, 41, 82, 90, 1191, 1814, 1818: n = A, T, C or G
gcgggctacttgcaggagcccggnngcancctntcnnntnntgggaccatgtaccgggacccgaggcggccagccaggggcnccctcgcngacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccctgaagatcatgaaggcccaggagctgccggccaaggacttcagcggcaccagcgaccccttcgtcaagatctacctgctgcccgacaagaagcacaagctgaagaccaaggtgaagcggaagaacctaaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccaatttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaancactggaaggacatgattgcccgtccccggcagcccgtggcccagtggcaccagctgaaggcctgagtggggccaagggaggcccagggggccagggcccaggtccccatcatgccctaccactttatgcacaacgcccggcctgagccccctgccatagggaggggaggaccctgagggctcagccagggagggkycccagraytcaaatgggccccgtttctaggaartaccagccccatcccccaaagtccagctccggggaaggggctctgggaggcattttcctgctttgccccttttcttcctgacttactaatactaaagaagttgggggagctcgagagccagacggccagacaggcagacccctccagaggcccgcccaggtgggcatggtcccccattttctttaaggcagcaccctggagtggagagaggccactccctctccagcccccgatgtggacccggggaggggaggctgaggcgtttgccccggcctggccaggagaggcccatccccagggcagtttcaggtgccggctgggccctgaatgtcgaggatagtatatagcccgctcctgggtcctggagctgtgrcagttatyyactcgtaaaanttan

SEQ ID NO: 169 - DNA, 2473 bp, Homo sapiens
ttgtctcgcgggagcgctgctggcggtcgggcgctcgggcggccctggggcgcgagacgagttgcatgtgttggttcagctggcgatacggcgggagcggagccgcgggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctctttttttttttgacagagtctcgcactgttgcctgggctggaatgcagtggtgcgatctcggctcactgcaacctccgctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgtggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatatatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaa

SEQ ID NO: 170 - DNA, 411 bp, Homo sapiens
gcacgagggtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtg

SEQ ID NO: 171 - DNA, 753 bp, Homo sapiens
taccgagctcggatccactagtaacggccgccagtgtgctggaattcgcccttactcactatagggctcgagcggccgcccgggcaggtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgctttcttaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggacgtgccgggtttatcattgctttgttatttgtaaggactgaaatgtacaaaacccttcaat

SEQ ID NO: 172 - DNA, 1535 bp, Homo sapiens
cgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataaaaaaaaaaaa

SEQ ID NO: 173 - DNA, 1376 bp, Homo sapiens
ctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaaccctttttttttccgacaagtactggagaactttaaactaaaggccatacaagacacaaacaatttgaagagatttatccgacaggcagaaatgaatcattatgctttgtttaaatgttacatgttcctaaagaactgtggtagtggagatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacaaaaaaaaaaaaaaaaaaaaaaaa

SEQ ID NO: 174 - DNA, 1622 bp, Homo sapiens
attagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaaatatgcttccgggccaaggtcaccgagggggaccttgggatttgtgtcctccccagtgcttagagtagagatacctgcaaattcatggcaaacagttggaagaattacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcattgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaaagtgttggtttttttttattgtaacactctgtgtaaacgttgacaccttattaaatattaaatgtctgaactctatttttaaaaataaaacaagcacagagtctgcaacaaacatgttaaaaaaaaaaaaaaaaaaaaaaaaaaaaaa

SEQ ID NO: 175 - DNA, 1316 bp, Homo sapiens
aaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtacgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaaaaaaaaaaaaaaaaaaaaaaaaaaaaaaaaaaaaaa

SEQ ID NO: 176 - DNA, 1523 bp, Homo sapiens
aatttcctgattctcaggtgactaaaaagctagcattctatgtattaaccttacaacagactctgtaagtttgagctttaaaaaccaaactttgacataaccttatttcttgtatttgccccctttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgccaaaaataaaaaaaaaaaaaaaaaaaaaaaaaaa

SEQ ID NO: 177 - DNA, 1404 bp, Homo sapiens
aaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatacttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgtttcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaaaaa

SEQ ID NO: 178 - DNA, 1403 bp, Homo sapiens
gtttaatttattagcatcttaatgtaccccatttttatatactgaatgtggccttttgagtgaaataggaagcttcatggtgttggagccacctttgtacagttgtttaaagtttcccattgtcacggaaaacattggttgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccatgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcaaaaaaaaaaaaaaaaaaaa

SEQ ID NO: 179 - DNA, 1823 bp, Homo sapiens
ggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagaaaaaaaaaaaaaaaaaa

SEQ ID NO: 180 - DNA, 1788 bp, Homo sapiens
gtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaaaaaaaaaaaaaaaaaaaaaaaaaaaaaa

SEQ ID NO: 181 - DNA, 1499 bp, Homo sapiens
ctgagcggcggggggcagtgtcgcctcggtctaggcacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgccgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctaaaaaaaaaaaaaaaaaaaaaaaa

SEQ ID NO: 182 - DNA, 1667 bp, Homo sapiens
tggcacgagggttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagatttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctgtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaaaaaaaaaaaaa

SEQ ID NO: 183 - DNA, 1835 bp, Homo sapiens
atccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtgaaaaaaaaaaaaaaaaaaa

SEQ ID NO: 184 - DNA, 1341 bp, Homo sapiens
ccacgcgtccgggcgggtgaaggtgtgtgtcagcttttgcgtcactcgagccctgggcgctgcttgctaaagagccgagcacgcggtctgtcatcatgtcgcgttacgggcggtacggaggagaaacccaagatgtatgttggtaacctgggaactggcgctggcaaaggagagttagaaagggcttcagttattattgtcttagactggatgattgaagggacattatgcttatattgtcaatcgttcagccggcgaagaagaagcaggtcacggtctagatcacatctcgatccagaggaaggcgatctctcgctcacgcagcaggagcaggggacgaaggtcaaggtcagcatctctcgacgatcaagatctatctctcttcgtagatcaagatcagcttcactcagaagatctaggtctggttctataaggatcgaggtattcaacccgtcgaggtcaagatcaagatccagctattacgaccaagaagcagccgatcaagtccagactcattcaagagtgtccatagagtctcgatgcttccgcgcgttgggagctctcccatatggactagtgattagtcagccacgccaggggatgaaggactgctacaaggagtgtgaagaggaatggggaccacgggaagctggtggggtcctcacccatctgtggtttttagtccgatggaacagatactatcccatccacagaaagcctttatctactaggagactaagaaaaagaaaaatactcagacttgctaggaccacaggtgtgggtgtttgttgggaaaaagtattgggaagatcggggtccatagggcgaggcgtctctgatcccctttgaggtttaactttctgcttttgatttcctgttagcatttggcctcctacagtggctgactaataaaagggttccggggttttttcccaatccccgtcgaggtcaagctccaagatccaggtctatttccacgacccaagaagccagccgatcaaagtcccagattctcatctccaaaaagaagtcgttccccatcaggaagtcctcgcagaagtgcaagtcctgaaagaatggactgaagctctcaagttcaccctttagggaaaagttattttgtttcacattattataagggatttgtgatgtctgtaaagtgtacacctaggaaagataattcaaccatctaatcaaaatggatctggattactatgtaaattcacagcagtaagataatataaataaagttgaatgtattaacatcatatggtctgaaaatgtgggtttttatttggcacatttaaataaaatgtttctaactagaaaaaaaaaaaaaaa

SEQ ID NO: 185 - DNA, 2442 bp, Homo sapiens
ggacgagccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtgtttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatccttataaaatattttaaaaatattaaaaaaaaaaaaaaaaaaaaa

SEQ ID NO: 186 - DNA, 6313 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgctccttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactataggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggatttggcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctctactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaacccaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatacctgctcct

SEQ ID NO: 187 - DNA, 3377 bp, Homo sapiens
gggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccggaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctggaagtttaaatttttataagcataggtttgatgttgaaaacttgttttgagggagaaaatccctttgttttaaagtaaagtaaacattatcgctaagtgtaacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgtttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaaaaaaaaaaaaaaaaaaaaa

SEQ ID NO: 188 - DNA, 4408 bp, Homo sapiens
cgacagcgagcggagggagggagcgagcgagcgaggcaggcaggcgggcccgggagggagggagggcgcgcgggcggcggcggcggcgagagcagaggacgagccgggacgcggcgccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcacaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagcattatggccctaagggcctggagccaccagaagaagagaagaatccctacaaagaagtgtacacggacatgtgggtggaacctgaggcagctgcatacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgaaaggactggccctcccggctccagatgttcttcgctaataaccacgaccaggaatttgaccctccaaaggtttacccacctgtcccagctgagaaaaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggaggagaggaaaaaagggaaatttttaaagaaatctatatattgggttgtttttttttttgttttttgttttttttttttgggttttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgtaaaaaaaaaaaaaaaaaaa

SEQ ID NO: 189 - DNA, 1263 bp, Homo sapiens
gtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcatttttttttcctcagagttaaaattatttccctcatactaatgcttaatggcaatgattactccagagttttttaatttttacactggggcaatagactaggaggtctctgatttcttcttggtctaaagtgttttgatttcatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaa

SEQ ID NO: 190 - DNA, 1660 bp, Homo sapiens
cgggcgcgagccgccgcagccccgcgcccgctgctctctgcggagccgttttgtgccgcggcgcgggggaacggggacgcggggcggggggcgcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggatagaccctttttccggtaactaaacttcttgcgggcagacacagcgtttgagttttcgcattggcttcaaacaaacccagtggaagtggacagtgaacaagacacccccgcaggaggcccgggcacggggtgtggctgccaggcctggccatggaaggccatcactgtgggctcttctgggagtggcactgacagccagcaaggagaatgggtgctggggcggagtggaagaaggtgagcttgaggccggagttcctaccccaggaggcaccgtcagcgtcccacttctgctcgtgtgatcccctggaggcacctgaatcaggcagtaaacatggagtgagaaacaccggagtagaagaccttgcaacagcacatgtgtgggcccagttcctagctgccccgggtggccaaggccacatcctgtacacacaggtctgggagtgtctgcatttcagcccttgaccgtgaacttgaccctctggaggtgtccatcttgatgtgatcctctgactgcaacctcatcctctgcctctcagagctgcctccccctgtggcttcttgccctgaggcatgggaggcgttggtgccaggagcttggggtttgagtcaggttggctcggggataagacccagcctttccacacattagtttgtgatgctgggtcatagtgcgtctgtttgctccctgtcaagggaccagtaacatgaggggtcagagaagggatcagaactctcgtgggcctccagtgtgtcgcaagtttttgctgttctgcttttcctcagctgctggtgggaatgcaaattgctgtgctgactttggaaaaactctccggcagtaaagcctaaagttccacatccacacaccgtactgtggcccagctgatttctctcctaagggtatcccggagtaacttctgcacatggatgcctgggacttcacagcccttctgcacacaataacagaaacctggaagccacccagatgcccatcagtgggagaagggatgaatacacgaagacacgatcacacaatggaatattatacagctgtccaaacacattaactgcagcataacttcagtgatgtaggtggactctggcaatatcataaatattagtaaaaatagcatgttcccaatgatgacttacagcactatgccttttaaaaataaagttaaaagcaactacaatgactgtactctctaggaaaatttacaggtgcaataaaactacataaaaaagcaaaaaaaaaaaaaaaaaaaaaaaaaaa

SEQ ID NO: 191 - DNA, 1527 bp, Homo sapiens
gggattaaggcgtgagtgactgcgcccggccatttttttgtatttttagtaaagatggggtttcaccatgttggccaggctggttgcaaactcctggcctcaagtgaactgcctaccttggcctcccaaagtgctgggattgcaggtgtgagccaccacacctggcctcgtttcatcttcatatcagcactgatgtagatggtcttatcctcattttataaatgaagaaatgaaggcttacatagtatgattggtgaaaggcacaaggctgaatggcaccaccaaatgtgctattgtgcctgtgtccctggctctaggaatactcctagacctgcctcaaagctgccgtctagttcttgaggcactttgtgatcagtaggttaatccttctgacttaacccaaaagctttggggctccactttcttttcctctctgaagactgacacagctcccagataacccctccccactttgaggacttgatgctgtagatggttttaatgaagccatggccttctctggcaatactgtaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctggaagaattaggtctgtggtttacttcatctttttttcagggcctctaacaattttgtttttcaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggaaaaaaaaaaaaaaaaaaaaaaaaaaaaaaaaaaaaaaaaaa

SEQ ID NO: 192 - DNA, 6061 bp, Homo sapiens
cgttggccgggcccgggggaggaggggaatctcccgccatttttcaataatttcctccggtgctgctgaggagagtcgtgactgccggccgccgggacccgaagcggaggtcggcggggggctgctgggaggcgcggcggtgtgcgcgggagctctgcgccggtggcgttccgctccatgactgtcgcgcggccgcgccggcggtgagggagccggagttcgcgccgccctctcacccctcccttcacccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcacttctattcatctagcacggaagccaaatttgggttaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacatgatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtgcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattgagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtt

SEQ ID NO: 193 - DNA, 1912 bp, Homo sapiens
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaatttttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcaaaaaaaaaaaaaaaaaaaaaaa

SEQ ID NO: 194 - DNA, 7898 bp, Homo sapiens
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcaggctggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgaccccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctaagggtcatcagccgggccccgggcctcaagctggtggtggagacgctgatatcgtcgctcaggcccattgggaacatcgtcctcatctgctgcgccttcttcatcatttttggcatcttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagcactttccccagcccagaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggatgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccactggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcactgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggacgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccatccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgc

SEQ ID NO: 195 - DNA, 1109 bp, Homo sapiens
atgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagatggagtctcgctctgttgcccaggctggaatgtagcggtgcaatcttggctcactgcaacccctgcctcccagattcaagcgattctcaagcctcagccttccgagtagctgggattacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctga

SEQ ID NO: 196 - DNA, 1647 bp, Homo sapiens
gattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggccgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaaaaaaaaaaaaaaaaaaaaaaaa

SEQ ID NO: 197 - DNA, 8220 bp, Homo sapiens
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttccaggtctgtgcagcacagtgtgggaccccaggagtgtggatctgtggaggcattgtatttggagaactccagcgacaaaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttaggaaaaaaaaaaaaaaaaaaa

SEQ ID NO: 198 - DNA, 2122 bp, Homo sapiens
  misc_feature 16, 17, 190, 2100: n = A, T, C or G
ccgctttttttttttnnttttttttcgatttatcgttatttattatcaaaatcatgaccagtgtgtagacatacttgtgaaaatatacagcaacttggggcttataacacatgagcaaagatgacattaacacgtgcactgttcacatcttggggtctagaggtcaagaacaaagatcacagacaagacnttactaaacggacccctgcagtaggtcccgaattgcagaatcatccaattccagcatggtcagcacggagatattcacagaaagaaacccagcaaagtcctctctgagccgctagagtcaacaagcttttcatacacactatggagagcccacgccccacataacccttgagaacacagttccatgtcttggctaacacggctctcaccgctggcctcaacacccctgggccatgctccctctgctcttccatccccaccacaacgaagaaaggtatgaccgcacgttatatatagtaaagaagaactttgaggccgcaggacagggccgcagcagcaagctctctgggtagtgccttactgctccacccacctgagccctgttccaagtgcaaggagcttcccaaatcctagagaatgactgtacttagaaagttttgttttgtttaagagaaaatggctttacatgaatttatgttcctcatggcagatatgttacacttccctctaaacagaaagacaagcccaggtggggcccgggcatcctcgaggaatgaagcagccattcccaccacctctcagggactaacaggtgcatgtggacacttgaaccacgactgtgtccacagctcctcctggaccaggcctggtgcctgagtgtgaagactcctggcctgcgtggcaggggcagctatctgggagggctaaacagcctggaggctgagtctgcagaggaagggggacctgaaagagcccaggtacaggtgcccatcgtgttcgtgcacctcgctgatgtaggtggccaccagcccatcgggatcatgcaggcttctccggaaggcaccgctgtcgctgagttctaggacgaggctgtaccgcggcacaaacttcatcaccgtctcttgactaaagagcagatcacaaccagcgcagcttcccttaaaaatcatccttttaatccagggtctctcagataagaaatccagcatggaaaacccagggttagggcggatggtcgacatgcccacccagtaccccccagagctgctgggccggatgttgtctggaaatccaggcatgttctccacaaacagatcagccccgcccttcatcaggccagaaacgtagactcttcgtatcctggccatggttgtttctgccaccaggacaaagtcttctgcaggagacagctggactccattcgggaaccgcagctggtccaataaaacttttacttccctggtcacagtatcatactccagcaggcgcccgtcatctgtgccctccatcaccagaagcaggtagtctcgtctttgccatttgctgctagaatcggtgaaataaatcttcctcccatcctgagtgactgtaagatcattcacaaaggacatgttcttcccctcaatgggtgtctcggaggacagcagcagtttcacttcacgtttccagggatttacttcaaatagtcccttgtatgcatcggccacaaagagagtcccattgggccctgcacggatacccaggggtctcccacacacaggctcatcatctcgggttttgcaagggcccgaaccaaaccgggcaatggtctctatttcaccattttcaagttttacgacccggccatctgctgtcccagtaaacatcacatccccaatatgtgctatggactccggtccaacaagttgattttcaaacagcctttctgcctgtcgcagcttcgtatttggatgcagaacaccaagcaagagcgggggttctttgaagctgagaggctgtggatctataggagattccagcagcatcatggctccaagcaggggaacggtgagagaaacagccagcatcaagaaggtcactcggaaaactctgccgctaaaggagctgccgtccttagcctccggggcctgnccatcattgtatgtgacgacct

SEQ ID NO: 199 - DNA, 2861 bp, Homo sapiens
tcgagcggccgcccgggcaggtcggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtttgtatgaaaagaaactgttaaacctaactgtccgaattgacatcatgggagaaggatacatttcttacactgaactggacttcgagctgataaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatatactgtacaacacactggatgatttgctattgtatataaatgctcgagagttgcggatcacctatggccaaggtagtggtacagcagtttacaacaacaacatgtacgtcaacatgtacacaccgggaatattgccagagttaacctgaccaccaacacgattgctgtgactcaaactctccctaatgctgcctataataaccgcttttcatatgctaatgttgcttggcaagcatattgactttgctgtggatgagaatggattgtgggttatttattcaactgaagccagcactggttaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcagatatctaagtaagtggagaagactattttttcaacaaacattttctctttcaccctaactcctaaacagcttactggggcttctgcaagacagaaagatcataattcagaaggtaaccatcgttatagacataaagtttctggtcaaaagggttatagttaatgctctgcactttttcctgcatcttatgcattacaatgtctagtttgccctctttccctgtgtttgtgtcataatagtaaaaaatctcttctgtttggcgtatagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgcttcgaaaaaaaaaaaaaaaaaaaaaaaaaaaaaaa

SEQ ID NO: 200 - DNA, 1104 bp, Homo sapiens
cctgctctgtagagccggcggcaaccgggtagcttggccaggttgtgaggaaccgcagcgcccgcaggaccgggccgctgagcctgcagccgccccgcgccgtgacctgcgaccctagaccccgactaccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaaaaaaaaaaaaaaaaaaaaa

SEQ ID NO: 201 - DNA, 1208 bp, Homo sapiens
aaagcgagagtgagtgggaccggaggggcggggcatcatatgggcggggctgaggcgaggccccggcggccatcttgagccccgccttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagagggttatgatcatagctactacttcattgcaacctttattactgaccacatcagacatcatgctaaatacctgaatgcatgaaaaaactccaaataagagaatctcttcaggattataaaagttgtaaaatgcaactgtattgctgagcaaaaaaaaaaaaaattcaaaacattggattttatagtgctaaaagggctttattctatagttgaatcacctctgaataaagatataaaacctaaaaaaaaaaaaaaaaa

SEQ ID NO: 202 - DNA, 1164 bp, Homo sapiens
gcttttttttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 203 - DNA, 2736 bp, Homo sapiens
gaaaaggcaaatctacccttcacagttcctgttaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagattaaagaataagatatgaagaacaacgaccatctctcaaggaagcaaagtgtctttcattagttatggatgatgaaatagaaagtgaagcaaaaaaagaatcactttctcccagaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcaaagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtattt

SEQ ID NO: 204 - DNA, 1382 bp, Homo sapiens
agaacatccggcgaagaagctcaggagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaaaaa

SEQ ID NO: 205 - DNA, 3835 bp, Homo sapiens
gcataagtttttttttcttaaaaaaacggcatctgcttaaagggatttatgactaaaattgcttatttttctacagagttgtctgctggttctcagcttgaagaagattctgaagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggttctggccccttacaagagagatctctctttgagaaaaagagaggcgctccttcaagtagcaatattgtagacgttcattggactcttaccgaaagggttatccccatctgtgctctatatgtgattggccaggtcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccagaggaatctgggtgctggaaatggaacctgcaaggacctagacacatgcagaaaggcagagtggaaacttagcagagttgttcacatcatgggtttttcaacggaggaaaaaactttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatgtaaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaaaaaaaaaaaaaaaaaaaa

SEQ ID NO: 206 - DNA, 1282 bp, Homo sapiens
gggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaaaaaaaaaaaaaaaaa

SEQ ID NO: 207 - DNA, 2446 bp, Homo sapiens
gttgaggcagggccggggcgggagggcgctgtcacttggtgatggtgttcgcgttcatgctcttgccgctgccgctgagcacgatgtagggggtcttctgagccttctgcttctcctggagcagggccacggtgcccaggggcgtgtcgctggagctcatcttcttcaggagcgcctcctcgtccagcttcttcatccgccgctctgtcttcatcttgcctgagcccttgccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcctgcccttcctgctccaggagccgtgccccggctgtcccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaaaaaaaaaaaaaaaaaaaaaaaaaaaaaaaaaaaaaaaaaaaaaaaaaaaaaaaaaaaaaaaaaaaaaa

SEQ ID NO: 208 - DNA, 1969 bp, Homo sapiens
cgggtcgacccacgcgtccgcgcctcggagcaaccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggaatatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattat

SEQ ID NO: 209 - DNA, 1472 bp, Homo sapiens
atccttcacctgttgcctggctagagttgtctggctccactttgagctcttgcagaaccagccctttttcgtgtggtccaggaaagtccatgcctggcaccacctcctcctctagtgactccacgtagaagagagtcctggctggctgctgagtgccctgcccaggagccccttgctgcagcctcgtggcaactggaagcagggtgccattcagcggattgaaggaagaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccagcggagtcgcagaatgtgcttcacatcgaagtcttttcgcccagagcctgacatgctttacgcacagaaggcaaaaggctggcagctcacgcagggttctggaggctgggaagttcaagaccaatgcacgagaatttggtctaaagagaatcttcttgctctgaacacacatagtagaaggcagaagggcaagagagagaacaaagtctgtgtctccacatggcagaagagcagaggagacagaacctactcctctatggcaaccaccccatcaatgacaaaaatcctagaaggatgtatgtataggaagttgaagtgttgagaagagaatggctcagagtcaagcgggaacaagattcaaacttcagagagagagggaagaaaaacatttaaatatatctggcataatccaagactatttacgacaagtgttctgtgtttctaataataaaacagacttcacctcggagtacctgcagaactgggaccccaatgaccagggagaatgaagaacaacttgtttgaagattgccttttctgactcccagcttccacggagagattaactctgttggctgaagccctatcccaattccttggctagaccctgggtccttcatgttagaaaacctggctttactactactactactactactactactactactactgctactgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgcattttttaaaaatatattatcttattttactatttgatgttataattgttatatatttttccatacttcctcatactgcttatctcttacttaagaatttatgaataaagaattgatttttca

SEQ ID NO: 210 - DNA, 2411 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctga

SEQ ID NO: 211 - DNA, 1641 bp, Homo sapiens
ctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtggccctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaaaaaaaaaaaaaaaa

SEQ ID NO: 212 - DNA, 1798 bp, Homo sapiens
gaataaaattatatatgtccttgggaaatattatgacagttgactttaagatcaaaaggaaaggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcccgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccattaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaaaaaaaaaaaaaaaaaaaaaa

SEQ ID NO: 213 - DNA, 1966 bp, Homo sapiens
gtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaaaaaaaaaaaaaaaaaaaa

SEQ ID NO: 214 - DNA, 1176 bp, Homo sapiens
cccagttcctgacttcccagaggcttcgtttacccagcaggcccctggaggtgtgtagtcactctgcccccactggctcaggcccctgtcacgcttctctgtgcccacgtttctgacctggtgctgccactgttgtcagtccctgggcctgagtccctggttggacaggaatggacccaaagaatggtgttggtatgtgggtggtcccactcgctttggtcagtgggcttctgggtccccctttccctcaccggccctgtgtgggtggagaggcgtgagcaccctatctcagctgctattcgggcatgatgctttgtagagggtagagtagacagccccctcccctactcaccatggtatttctccttgaattcctctttcttgttttctttcctggttgtgtgaaccagttgctgctgtcatacccctggcagggccaggggacctctctttggtcatctctgtcctttcactggctgctgccccaggaagactcctctaggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctccccttttcctgccccgtcccatgcctcagcttgctgcttgtgccagttgcctgtttcgcttcagtgtttgattctagcacttacatgtgtcctccccaccaagccctctatctccttctaatccttcaacccctggccccctccccgtaacagtgacttttccagggaggaagaggcagcaggagctgttggccttggtttgcacagagcgggtagggctgtagggaaagcgggtgagctgttgtgctgctgggcctccctttggccctcgcttcccaccctacgatgtatgaaatgtatgtacagaccagagatgtttatacagccgataaaaaaaaaaaaaaaaaaaaa

SEQ ID NO: 215 - DNA, 1946 bp, Homo sapiens
cctcgtgccataaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaaaaaaaaaaaaaaaaaaaaaaaaaaaaaaaaaaa

SEQ ID NO: 216 - DNA, 2586 bp, Homo sapiens
gtacattaaaaataatttaatagccacaatatgatgttctttaagctgcaaattgagtacactgggaatcaacaaatttgatgaagcctgtctgtctcttcaccagtggagtgagtgcagcagttagaaagagaagcaatattgtgcaactggtgcagtggtgagttaatcatagtgtataaccttgtgttcatgaaacaggttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaatatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgattttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctgaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaattaaaaaaaaaaaaaaaaaaaaa

SEQ ID NO: 217 - DNA, 1257 bp, Homo sapiens
tgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaaaaaaaaaaaaaaaaaaaaaaaaaa

SEQ ID NO: 218 - DNA, 2076 bp, Homo sapiens
cttgaataaacagagtacccttggttttcctactttatagatgggttttacttaccagcagaccattttgtactttatttgagtctattcccaggactgcataaatttctccccacataagaagacccacaagtccacttatctgtggaggtgagtggaccatgtaccatcctagagcttcttccatgttacacaaggacacaagatttggatcactggtattcacaaagagcccttgttaatagtatgatcccaacccattctcactggttgcagaggaatgtccctttatgttatccttatgttgcagaactcggaaacaatagccacttcatgaaagcaaatgctcgcgtgcagctaacagtgcattggatttccactcacattatcagacatttgttttctagactttatcagtggaaccttaaagaaactttgatttcaccttagatttttatcggttccaagcctacaggtttattagcaacctgaacttcagcagcttggtatataggccatcatcctcatttacactatgaaatgtttgatatttgttcaatatccctgtgtctgtgccttactagcagaaactagagcatgcaggtactggcattttcttggtttgcatatatgcagtagctcattaatactctctggcagcaactgaaactggtaagttatcaaagatatccagcgagaagagaaaaaacctgatatgtgagccaagggacgtttgtttagttgttgttgagggtggagggaatttagagaagatttgaaattaatttccaaatcaaatttgagagcaccttgtggtaaatggtagtctatagcatctcccttagtccaacatcctgtaacaaagagatcttcacatgtagccattctgatattttgaactctttgtagttgttttagctttattactaaatttttttccaagatatgtatgcttttcaaatgggaagcatgtgattctatccaaaaagtagcccagtgttaatacagtaatttaagaaactgtccagcagaggtctctgaacttcatggtttaagaagagcatttcaaacaataaatcaaacctgattctttgcatgacagaaatatacttctattgagcatattttccagattggattttagaataactgtatttcacataggttaaactctgcttattcatgtttaaagacgctgaaaacttatgttttcagatttttattcccctaacaggataaaagcctggttaccaccaactttgcactataaaaagaataaatatatatgaaacgtagaagacaaaagcaacaactaatattctacaatgccaccagcactacaaaggcattgatgtagtttggctttctttctatgcagccaaaatccataattaaatcaagcaactggctgtattgcttgatttataaagaacatgcatgattggactgcaaacttttctttgtgcaaaagcaggaaataaataaataccaatttgtatgttttgtgttgccagcgatgaaatctacattgctccttcaggagtgcaaaaggaacgaattcaggtatggtaatgggattctttaacctcagtgtcttttcttcttaattactgttttatgaaatggaattaattttaagagaaaacattcattttatcatagcaatttgaataactaatcagcaaacatttattgagtaattattaaatgttttgtaaggtggtagatatcttccatacaaccggtgtatgttttgaaatctcattcaacctatagggggcaaaagtgaatagtgcaatcttaaatcacagtaaagagcaattataactttgcagctttataacactacgatctttatcaggctggtggaataatcagattgatggtctcagatgaaccaaattaattcatatttcctaatagcaaagttattctaatttcaggatttcaagttatgaaactttgtttcaaattttgagaagtcttattctgtgttaatgccagaataataccccaaatctagttaaagcaaacacataattatttaacttctaatgcaaaaaaaaaaaaaaaaaa

SEQ ID NO: 219 - DNA, 1462 bp, Homo sapiens
gtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaaaaaaaaaaaa

SEQ ID NO: 220 - DNA, 1527 bp, Homo sapiens
ctctacaagtacttctatgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccgctgcaggttcctttggcaactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattgagtgtaactgcaaccagataggctccgtgcacgaccggtgcaacgagaccggcttctgcgagtgccgcgagggcgcggcgggccccaagtgcgacgactgcctccccacgcactactggcgccagggctgctaccccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgccaaaaaaaaaaaaaaaaaaaaaa

SEQ ID NO: 221 - DNA, 1805 bp, Homo sapiens
attatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattaaaaaaaaaaaaaaaaaaa

SEQ ID NO: 222 - DNA, 1705 bp, Homo sapiens
cttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgcactgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgtaaaaaaaaaa

SEQ ID NO: 223 - DNA, 4658 bp, Homo sapiens
ggaattccgggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggttctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgccaacctgaagccatctgaattaaaaaaagatacatgctactctccaaagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggaaagaactggaaaaactgcgaaaagatttggaagaagagaagacaatgagaagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgctcagtagtttttttattgaaacttgtattatttttaaagagatctatactataaatatggtgatatatttacaagtaatctgtaagatatactatttgagagggacagattagccttttagtaactatagtcactactttttccataatgcataagggatataaactctgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaaaaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcaaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatattgaacatattttaaaatacatttcacagaatggatgaattagttgtttcttcaaaagttacttatgaacagttgaatgcctttaaaatgttctgtctgtaggtacatctaaaaacacaagtgggtttatttaaatttttaaaatttgaaattttttatttgccaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgttaatgaaattttgtcatgtttcaaataaagaaaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttctccttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatactcttacctttctgtccttgataaaatagtaaagaaaaccaaacaaacccaggcctgatgggaaaaatgattcctttattctagcaattactttctgttggtatgggaaatgttattaatttctattactaaagttcatatcacaaaatgatatttaataataaccttggggtaaatcatgaatttttttttctacgtgtgagtataaaagacaaaagttgaacagcatggaatcttcattgccaaattattagtgaatgtatagttcaggtattctttgagacacacagtatcattaatttccgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatccggaattc

SEQ ID NO: 224 - DNA, 4623 bp, Homo sapiens
atgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 225 - DNA, 4641 bp, Homo sapiens
atggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 226 - DNA, 662 bp, Homo sapiens
acccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtctgatgaaagatctctacagaacttgtcaaatctttgaaacttggaatatattgctttcataatatgaaggtttattggctatctaaaa

SEQ ID NO: 227 - DNA, 3270 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcggacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtc

SEQ ID NO: 228 - DNA, 722 bp, Homo sapiens
gggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagcactctccgaatcagagcagtgcctctctcagatacaagaattaataggctcaatgccaaagcccaaccatgacactctacggtacctcctggagcatttatgcaggtgatagcacacttcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtatttt

SEQ ID NO: 229 - DNA, 1659 bp, Homo sapiens
gagccgctcctttccactcgggaaaccttcagaggagtctcagaaaggggacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataagggatggcaagaacaattcctcattccaaattcggctctcattgataaacaagagagtgagattacttatctggtaccatggtgcaaattagaaaagcctccaaaagaaggagtctatgagctggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagattccttgacctctttccattttggtttccaaaattagctccttctaactggattcctgacaactcctttgctttaaagcatttttgtgtattccaaatgataatggtagcaatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacatatgaaaaaatttaaaaagaaaaaaaaaaaaaaaaaa

SEQ ID NO: 230 - DNA, 577 bp, Homo sapiens
gtgggctcaggcccagagtgccagctttgccctatcccatagcctggagccaccacaggaggggcactccactctcttgggctcctggagcctcagaggcagagccagccgggagtgcaggagggagaacttccctgtggacgtcctgtgttctccagacgcagagaaccctcatcaaccgagggggaggtcacttccgaatccacagatggcgtgtgagtgcatggcgagcgcctccaggacacacttactgttcccttgctctggccagacgccagccggaccctgtgtgtgcgcgccgtgctgctctttgcagctgcctgcaagggttcctgcgaagaccagcaccttggggaagagcctgcggctgaacttgaactcgcagctacctgagtcagacctgtgctttttcacctctacggaagatgtcagagcgtttccctagcaatgttttagaagttacttctgtctggaaaaaaatggaaaaaatggcaaattatgttatgtataatttgataattttaaagaattaatgatgtaattattactcaaacccaaaaaaaaaaagaaaaaaaaa

SEQ ID NO: 231 - DNA, 5601 bp, Homo sapiens
ggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcaaaaaaaaaaaaaaaaaa

SEQ ID NO: 232 - DNA, 1617 bp, Homo sapiens
ggagcagcggcggcttgaggacccgggggagacctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctctccttcactgccgcctttgtcatctcctttggagggtgcatgggggacgggaggaggggcacgggtttaagggacttggggagccactggaagaataataaaagtgttgctctttatcaaaaaaaaaaaaaaaaaaaaaaaaa

SEQ ID NO: 233 - DNA, 2418 bp, Homo sapiens
agtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactcctcgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggggaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtactgggcgcatcccccacctcacatgtgacagcctgactccagcaggcagaaccaagtctcccactttgcagttctccctggagtcaggctcctccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatg

SEQ ID NO: 234 - DNA, 1371 bp, Homo sapiens
ctttgtctgacttacatcctctcaaccctctcccaggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccaggtgagttcatgcccagggcctgcaccaccaatctgagccagcccgcctgccccgacaatctccagatgtcgcgccttacttgcgacccaaacgacagccacctctgcacctgccgctggcagaccccgaagtgggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctcctgagccagatgacggggtgggaccccggtttagtaaggaccgggcgcccagtggctaaggcggtgcccgtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggatttggaccagcggttgtgaccatctttcctgagcaccaagggcttccccttttgttgccaaaaagtctggcctttccaatccccatctccttgccccccccttgcccccccccccgaaaaattgagcacttaaacccctccccttttggagggggccccctgaagcgtcaggctgggggcagtctggtacggaacatatttattgcctccatgcatgtgtgtgtgtgtctggtgaggactggtgtgcgtggacacgtctcaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacagg

SEQ ID NO: 235 - DNA, 1075 bp, Homo sapiens
tgatcagccgggggaactctgtgaccatccggtgtcaggggaccctggaggcccaggaataccgtctggttaaagagggaagcccagaaccctgggacacacagaacccactggagcccaagaacaaggccggattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcgtatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttttttttttttgagatggagtcttgctctgtcaccaggctggaatgcagtggcgcaatctgggctcactgcaacctccgcctctcgggttcaagtgattctcctgcctcagcctctggcaatttctagagggaggaatgggtgtttgagtgcagagacactggtctggggtgatccatggagga

SEQ ID NO: 236 - DNA, 2014 bp, Homo sapiens
caaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtacaagcatcactttctttgccagctacccctgttggcaaagggacagaaaacagttttccttcaccgaaagctataccaaatggttttagtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttctttgacaaaggggcagtaaatggctttgacccagctcctcctcctcctggcctgggctcctcgcgcccgttgtcagcacccggtatgtgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaaaaaaaaaaaaaaaaaaaaaa

SEQ ID NO: 237 - DNA, 2021 bp, Homo sapiens
cgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgaatggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaacctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaaaaaaaaaaaaaaaaaa

SEQ ID NO: 238 - DNA, 1415 bp, Homo sapiens
tggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttattt

SEQ ID NO: 239 - DNA, 1709 bp, Homo sapiens
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattcctaaaaaaaaaaaaaaaaaaaa

SEQ ID NO: 240 - DNA, 1643 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgactt

SEQ ID NO: 241 - DNA, 124 bp, Homo sapiens
gggaccatcttcagtgtaactcagggaaatgacctcactctgttgctcctcgtccttggaaacggagctggttgtatctaccgtgcagggatgtagagggcttaaattaagatgctccaagctg

SEQ ID NO: 242 - DNA, 1824 bp, Homo sapiens
atggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaccagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctga

SEQ ID NO: 243 - DNA, 1799 bp, Homo sapiens
tgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcaccggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaacaactatcccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagacaatagatgttgcttttcccgtgtcatgtaaatttgttcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagatggaccccccggaggttgtaaaatagactccatggagactcttaggaagcagtagataccccggggctgtgctttagcgttagaggaaaccacataggagctggaacctgttaatggaaagcagtcacagctggaggtttttcggaagaaccaaggaagattaaaatacattgcacttacaaaaaaaaaa

SEQ ID NO: 244 - DNA, 369 bp, Homo sapiens
cattaggtgtcaccaaagtgttaacaattccttgggaatttataaacaaaaaatatctagactaaaaatagaatataaggcccctctggaaccactgcacacctttccctctgttctcagattaaactgctgcataaaatgaggttatttagcctgtttttaaggaaggcttctattgcacatgcatctctttggttggtaataacatgtacttttgttaaaatatttccataatgaagccctgttgtgtggttagctgggtgtggactttcctccctttcttgggggccctcctactcacagtcaagttgccctttagaactaaagatctggtaggattgggtctttattcaatagcccctcgtgccg

SEQ ID NO: 245 - DNA, 2457 bp, Homo sapiens
gtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagcagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccaaagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggtaaaaaaaaaaaaaaaaaa

SEQ ID NO: 246 - DNA, 1853 bp, Homo sapiens
gcgagatccctaccgcagtagccgcctctgccgccgcggagcttcccgaacctctcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaccttg

SEQ ID NO: 247 - DNA, 2125 bp, Homo sapiens
tggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccatacacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgaggtaagagttactgacctttgtctgatcccagagggcccgttcttagtcatcaaagtggtatttagttgagcaaaagtgcaatatctgcttctctgtgtcagtgcagttaattgtgactttggacaagcatatttctctaaactggctccatccataggtgggcattcattctttctctttgacctctgttacctgttcatcctgctggtctcatgagatttgactggaaaacataaaagtgagctatagttgtaaacaaaattatcttgcattgaggcagaggaatttagcaaattctcatccagccagaggaatgggagatttccatgaacgctgaaggtaggagactcggaggagtcttgtaaacacaggaggaggtcatgaaggcttttctctttattcctgccaaatctgtaattcccacttgctgtgatattgcagcatgtgctcagtcacccaacctaatctctaagactgcggctggtttacagccctgaactcactgtccagaatacaagattcaaaccagggttgacccataggtctcactggttggtcttccatccactgccattcagacggatgccctggatgaatctggtgcggaagaccagggaagtggcaggacaaggaggcactgctggtggtggctgtggaaacacccagcctgacagaaggctttatctcagagtcagactgtcttgcccatgcttcagtcatgctgctttggcacatttaatgattttgtgtttccatttctgtagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgtcttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaccaaaaaaaaaaaaaaaaaaaaa

SEQ ID NO: 248 - DNA, 1542 bp, Homo sapiens
atggcggagctgcagatgctgctggaagaggaaatcccggggggccgccgggcccttttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccaaacgctgctgctgggggtgccccaaaccttgctgatggcttcacttctccaactccccctgttgtttcttccactccccctacaggtcatcctgtacagttctacagcatgaataggcctgcctctcgccatactcccccaacaatagggggttcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaa

SEQ ID NO: 249 - DNA, 1371 bp, Homo sapiens
gctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacaatcaactccgcccctacccaaggaccgacagcggctcccggagcctgccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagaaaaaaaaaa

SEQ ID NO: 250 - DNA, 463 bp, Homo sapiens
taaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccaaaaa

SEQ ID NO: 251 - DNA, 370 bp, Homo sapiens
  misc_feature 58: n = A, T, C or G
aggtgggcggatcacgaggtagggagatcaagaccatcctggctaacacggtgaaacnccgtctctactaaaaatacaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatact

SEQ ID NO: 252 - DNA, 462 bp, Homo sapiens
  misc_feature 50, 120: n = A, T, C or G
agaaattgtcaccaatatcagcaactctatggagtgcaggcctcccccanctgtgaagaggatcagcagaaaaaagatgagttgtagacactgatctgctaggcgtgtaatattgtaaanactggactcaggaacttttggtaggaaaaaattgaaagaacttaagtctcgaatgtaattggaatcttcccctcaaagtggagttgaaactgctatagcctaagcggctgtttactgcttttcattagcagttgctcacatgtctttgggtgggggggagaaaaagaattggccttcttaaaaagcgggtaaaaaacctgggttagggggggtgttccccttcaaaatgttttatttaacaactgggtcatgggcatttggtgtaggaagttttttttaccataagtgaccccaataaatgtttgttttttaaaaaaaaaaaaaaaaaaaaaaaaaaaaaaa

SEQ ID NO: 253 - DNA, 473 bp, Homo sapiens
ctattttttttaattggtagaggatttttatatattttttccattttgttgggttgtgtccttatttatataaatactttatccgtaagaggcaaggaggaaaccttctttgcttttacatattgtggttgtcatcgtccctattttatttctggtgtgatttctctgtcttaccttctaaatgagaaaatgttttcttgtatttgtacattgtcagattctatagtttcctagataatttaaccaaattgctctatgtattattattctgtgagtataaagttctattttaatgtctgtaaatacttcagaactggcttcttttctcaaactcccactgtggggttattgtttacatcacagaaactgtagaatctctatgctcatgtactgtaaatagtgaagtgatctgcttataaataaacttaacaaatacactatggagattaaaaacaaaataccacccaaaaaaa

SEQ ID NO: 254 - DNA, 545 bp, Homo sapiens
tcccgaacaaaggacctcacgtgaaatcctgagctcagagcttacagatatgtgtgcgctttcactttacatcggccgtgacttccaaacaacttcaggaaactttaggatctctgaggtatactggagatgacagcagcgtagaatgttcatttggatttagaacagaaatgcttattttatatttggctgctcccaaactggtccccagacttcctctccagtggttaccctccactgccctggatgtcccacgtttacactccacactcacacctccaccttaacaaagtcctccactgggtcaaaccatacatcgcttcgtctctgtagtgatgacttcctgtcctctgctctgtggataaagaccccagataaagatgcctgtgttgctcaactcttgtaaatactcttgagacattttgaaagcagaaggaaaggagacagacggggaaaataaaagggatggtctgcttgtgcggaaacgttttgagaatgcccttccctaagagagaacagtaaaagtgagcaatacttaaaaaaaa

SEQ ID NO: 255 - DNA, 384 bp, Homo sapiens
  misc_feature 4: n = A, T, C or G
tccnaaaaattacccttttgggcccctccggttttgggccttttcccccctgttttgtgggaaatgtttctgggggaataggcccccccccttttggggggggtccttttttttgggagggaggccccaaaatcctttttccccctggttctgggaagggcccggggccaaattgggggggttttttcctttttggatttttccctttttaaggggttttttttttttccccgcccaatttttttttaaatgggggggggaccccggtggccttataaagcgggtccttttttgtccccggttgcggggggaaaaaaatttttttttttaaattaaaaaaaaaaaaaaaaaaaaaaaaaaaaaaaaaaaaaaaaaaaaaaaaaa

SEQ ID NO: 256 - DNA, 255 bp, Homo sapiens
cccttcctggtgggggagacactgtcctgtttcagtcattccgttgctttgctttatagttttattaatgtgtttgtgttgactttgcatgttttcaaatatatgaatgaaatcatgcagagtttattcttttacagtttgccttttcacttgattatgttcctgagatgtatccggattattgtgtgtagctgtatggcattccttttccctgctgcctagtgatccattgaaaatacaataattgatttttca

SEQ ID NO: 257 - DNA, 360 bp, Homo sapiens
gcaaaattttgggggggatttttattttaataaaaggccctttttaaaagaagctgattttgaaactgcttaagggcattgcgggtgctcccaaaacttttcatcggaggggatttatttttttcggggacatccctattttttatttatcacaaagattttccccctttttttccaggagcccaaacaaaggagggggaaaaaaataaccaaaaattatgtttttgcttttgttttcaaaccaagggggcggggattccaaaaaaaactttgttaaattttccaataaaccaaagtttgataccggttaaaaaaaaaaaaaaaaaaaaaaaaaaaaaaaaaaaaaaaaaaaaaaaaaaa

SEQ ID NO: 258 - DNA, 557 bp, Homo sapiens
gaatttataaccttaaaaatgtaaagaatgtggaaaaccctataaatgtaaaaaatgtagaaaaacctttatttgtcttagtttacttggaaaccatgaacaaactcacactggaaagcgacttcttaaatatagacattgtgaaaaagccttcagttggcccacatactaatatgtgagaatgcagactggatagaaatcctataaaagtgagatatagcaatgttttccattttaacaaatgctcatgtgatactcccttatgtgtgaaacttcaatctcatgttgaaactcccactagggaggtactgtataaatgtagataatatgggaaagcctgatgcaaattaattcatgtatattgttctagaaaattcacaacatgtcagaaatgtgataaaacatattatcagttactgattcttaaaatggatctctgaattatggatttctattactttcacaaaagaacactgagatgagataattctgtaagctcttatacagttgtacacaagttgaattgatagtattttttcattaaaaaagtttctgaa

SEQ ID NO: 259 - DNA, 499 bp, Homo sapiens
attgtgggaagttttctgcaccctacattttctgttatggggattagatatccagtatccatgtttttccaagtcttacatcagaaagggtaaatacagccctcacagcagcctgttgtttgtcctgcagttgtgtttccatcacattacacaaagcctctttgtcttcgtggttgtaccctgctaataagttttttttaaattatgtaatatgtgtatatacaaatacctatatgtatgtgtgtacacatacagctgatatctactgagattatgtatgcatgaactatagaattaacttgtaattttaagaaaataaattattttgtaaagataaatctcatgtttaagaaggggaattacaattgaatcatttagggatgcctcagcctaagcataatatggaaaaagccataaccaaaagtcattttagagtactgctaggttactcaacctatcatcacatttaattaaaatgtcagttagaaccatgaaaaaa

SEQ ID NO: 260 - DNA, 407 bp, Homo sapiens
tcctttttagaaatttatcacctgtttctctttcagcctgacttacaaaatctaatttttggcctaaaaatttcccctagcttggtactagtccttttatttctgcctgtgattatattttaaaattaaacttaaatgaatctaattcattggatataaaaaaaaaaagtaagtggcttgctttgcttactctggttttccatcctcattcctggatataatcaagattgcagtaggctaacaatcttatgctgaaaacaagaatgaaaaacataccatcttttcaagttactttggacccatagagagaaagtggattggtacttaataccttccctgaatttaacagaattgatgtggactgtacataaaatatgttgaaaaataaaactatttttttggcaaaa

SEQ ID NO: 261 - DNA, 209 bp, Homo sapiens
tcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaacccaccagcaataaagcagtaaccaagga

SEQ ID NO: 262 - DNA, 675 bp, Homo sapiens
agtgtccttggggaaaccaaggcctatgtcttctttgagaagagctttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaa

SEQ ID NO: 263 - DNA, 1496 bp, Homo sapiens
gccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacgcaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaagtggatatgaccttggatgccgacacagccaacaacttcctcctcatttctgacgacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttacagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaaagtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatca

SEQ ID NO: 264 - DNA, 1739 bp, Homo sapiens
gcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaaaaaaaaaaaaaaaaa

SEQ ID NO: 265 - DNA, 3863 bp, Homo sapiens
atgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccct

SEQ ID NO: 266 - DNA, 1990 bp, Homo sapiens
aaggaacggacagcccgacctcttaggcgccgggaccctcaggctcagatcagtggccgaaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaattggcggagcggaaacgtgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaaaaaaaaaaaaaaaaaaaaaaa

SEQ ID NO: 267 - DNA, 4445 bp, Homo sapiens
cgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgttactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggcaaaaaaaaaaa

SEQ ID NO: 268 - DNA, 3516 bp, Homo sapiens
atggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaaactttgggatttgaatcaaaaaaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcctttggctagttgttcagctgatggaaccttaaagctttgggatgcgacatcagcaaacgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataa

SEQ ID NO: 269 - DNA, 331 bp, Homo sapiens
cagtctgccctgactcagcctgcctccgtgtctgggtctcctggacagtcgatcaccatctcctgcactggaaccagcagtgacgttggtggttataaccatgtctcctggtaccaacaacacccaggcaaagcccccaaactcatgatttatggtgtcagtaatcggccctcaggggtttctaatcgcttctctggctccaagtctggcaacacggcctccctgaccatctctgggctccaggctgaggacgaggctgattattactgcagctcatatacaagcagcagcactcgggtgttcggcggagggaccaagctgaccgtcctag

SEQ ID NO: 270 - DNA, 3919 bp, Homo sapiens
cccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggtgcacgaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaaaaaaaaaaaaaaaaaaa

SEQ ID NO: 271 - DNA, 3510 bp, Homo sapiens
caggaagaggtatttcttggggatgctaccaaggcagagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccagcacagcctactgaccccaaggagcctggcactgattggcatcacattgatctaagaactggtccagccgacgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggggtaccctggctgttctccacactcacaagacatcagctatatactctgcttggtgcataagagagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaatattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtataccactggagttttctggttatctctcgtatagcaaaatctaactgatgcaatctccatctggccttcatccttctccctttattgtcctttcgtgtattgttcatccagcaaccaggatgatcttgttaaaacattaaacagattctgtcactctt

SEQ ID NO: 272 - DNA, 1956 bp, Homo sapiens
ggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaact

SEQ ID NO: 273 - DNA, 4504 bp, Homo sapiens
gtgacttcagtttttcgtctttcaacttcagttgctcatctgcagtcaccagctgggatttgaacccagccaatctgactcctgagctcctctttcctcccacttagtcttttcccctgagtccaacagcaccttagagcatgtctaatgcacgtgcttactgccttcatctcattgcagcctgtccctgccagctgtgtcaccttcatcctgctgccagcccctggtgactctcccgttacagatcagagaccagactccaggggtggagagtaggggttctggaccagccgctctctgctcctagagctcttgtctacacaactgcctggtgctcaggggatgacgaggcgcctgcctctctcagtaggttgtgtgtcctggcagcaggggtgggacctgtcctctttcatagctccagcacatctgtgctggatgtcacctggctccatccagtgacggattcatattctctgtttcgacatcttcagttgctggacaactaaatgccatcttcaatacctttaatgccatctttttttttcttcttttgcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaaccccccatttattgccttctgagaggtgggtgaggacaagcatgtgcctgtgtgtgtgtgtacgcacatgcgtgtgtataagcccacctgagtggggctcgtgcaggagaactgaggcatgaaactctggctcaaacctaggaattgagagcgtttctgtcttttgggagagtacttttctccacgagccctctggccactttgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctgaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctc

SEQ ID NO: 274 - DNA, 4670 bp, Homo sapiens
ggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcatccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctctagctgcctctgctttcggagtgtccctgggaccaggatagatgtgggtgtgtctcagtggggcccccaggctgggaacacactcggaagatcccgtgtgtgcacgctggcttctcgggaccagccagggccaaggcttgggaaccatttgcatccaggagttagatgggaacaagtgtcactcctggtcacctggttggagggcatggattgaagctgccctcaagtccaggccttgaggcccacctgaggggagatactgcccttctctctgcctgcctcacctccagctgtcagagggtgagcagggccctggaggcaggcaccccctcctcctcctccccgtccccttctcctcctcctccccgtccccttctcctcttcctctccctccttcctctccctccgcctcgctgtctttctccttctcctctccctcctcctcctgctccttctcctccccgtaccctttttctactcttccctctccttctcctcctcctttctctccctcctcctccccctccccttctcctcctctctttctcttcctcttttcctcctccactcctctttctgagagtagctgctgctttccctgccttccttcctcaagaatacagtctattctggggggttgcaggacagctgaaaaagaaaacgtgagtttccagaaaagcacatcgccctttctctccactcgacacagcctgcggtttgcagtgccagctgcacgttggagtctcctgggaagcttctagtgttgatctccctcctagaggctcagtgaggtgatcggggggtcagtgtgttttcagagtcccagctgctctgacttacagctgtggttggagccctgacctaggtccttggtctaagaagtcaaggatgtaagtctattaggactgagtgttgaatggtcttgatggtgaagaaggaccttgcactgcctaccgagctccctcatgcctgcaatttaaataccgaggtgtgttctgagagccccaggtccttggggcacgggcctccagggccctgtaaggtggactctggcctcgaaggggggcccaggtctgaggggtccagctctggcagggggtgtctaagccacgtccaaatggtggacagtagctccaacagtgacatgacagagggagggcctgtgtgtgtggtgtgtgtgtgtgtgctgtgtgtgcacgcacgtgcatgtatatggtgtgtgtagaactgacacgcttgaagtccctgtcccgtgacccaccctcaggtacttgctgttgggttttcctatgattttgatgtgtcctgacccagcatatggatgccctccccttggagggcccagcctgcaaaccccatctgataccacacatgcctatgtcctgcaggcttctagtgacccttgcaagccgggtgaggctggtcccagtctctgtgcagatcttggccatgtctccacagccagctccccccaagcagtggccctggccctaccccagcctcctcagaacaggggtgaccactgcaggggagactgcccctaacctgtgtctttgtgtccccagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacatttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagc

SEQ ID NO: 275 - DNA, 4303 bp, Homo sapiens
ggagtccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggggcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtcccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagccccgctttccctggagcacctgccccacctgcccacagagaacacagtggtctcccctgtccgggggcggctttttccttccttggagcgtccctgacggacaagtggaggcctcttgctgcggctgcaatggaggcaaggtgctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtt

SEQ ID NO: 276 - DNA, 1547 bp, Homo sapiens
gagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaa

SEQ ID NO: 277 - DNA, 1239 bp, Homo sapiens
caggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatgtcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgattaaaacccaatatctattttttaactgattggataactctaagatctgatgaagtatattttttattgccattttgtcctttgattatattgggaagttgactaaacttgaaaaatgtttttaaaactgtgaataaa

SEQ ID NO: 278 - DNA, 1986 bp, Homo sapiens
gttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagaaaaaaaaaaaaaaaaaaaaaaaaaaaaaaaa

SEQ ID NO: 279 - DNA, 2133 bp, Homo sapiens
ccatggaatccatggagtcacagtcaagcactcctggagggatctgggtgccggcatctccagccagccctgtgatagagatctgaggagttccccttagagcttctcaaggaaatccttgatgcaataagccgcacacttagggaagctgttctctccagacagggtacaacttgagaaatggtttcaaaatgttttgacatgttcctgaatggcaggtctatgggagaacagaacgggggctgtggtatgtttgaggctttctgtgacctaggggtaggtgtcaggaaagcttccaaactctccctagaggccaagccagggctgcctgagaggctggacagtgggcactcaggccccactgggcagggacaccagtgtgtcatgcttgttgtcacacttggcttatttgctcttctccaccaggaattctgtggggcaggggattgcacactgcacacatcacagctgctcatccagggttcagggagcacaggtgttgtggcacttgcttcatcttgagtggcacggagcacagagcagcccctgtggagtgtggaaacaccaaaccctgagtcaccactgactgttgccctgggcatagaaccccaggtgaaggcacttaacactggttatccctgtgcatccaggaagctgagtggcggccaaagaaaaaagttacaatgcagtcaggctggaccagagaattcctgcatgtgcaagtttgtgcgtgtgtatgttttggaagtcaagccagatgtcgtctttcctcatgtgacatttggtatcttttttccacagcagtgttccattatgttctagttcttgaaagaggcagtgaggcaacaagtgtacgacgaaattgatttgagaaatgatttatgtgtattatagtcttctcttagaggatcacaaagtatattagcatattaaaggctctgagaagtcctgtaataaaggagcctggttgattgaatgattgtggaactcattgtgggtggatcattcgcatactggatggaatggggtgccaggctgactgtgcagagggtgattagtccctgaaatgtagataggggccacctagagaatggtggagcgtcggacatggatgggtgaactgaccaactgggctatgcatttcagccccaaagcacttaaagcataaggtagattgtaagatcctggagttcacctgccttaaacacctcctttcataggagaaggacaccaaggtcgttagagaagaactgagttactcatgatcaccagtcagagctcttggctgcaccacatagatgccaatgttggatacctagggagaatgagatttgatggaaggatatggagaaggccactgaacccactggaagactggagaaccgggtccagaaaacaagcagaagccaagggaaagtgggctgctgagagcatagccagatcatgccacgaaatctgattagcccacttcagctacggcccatgatgcatcagaaatggacccatggctctctgtgttcttcccagtgggtacaggtgattggctgagcacagactgcgttcccctccctggctgttagggtctgggagaacaggtgggaggcttttgtggcttctgcagcagaagcccggagcccatctctcccaacgactcacacaggaaggaagcccccatctggttgggggcagaatgaggttacaaagcccatctcctgtcttgcagttcagattatgcagccaagggtactcttttacataagtgtttaaaatcttgatttaatcagcaacatagaccttgcagcgttcctgcttccatgatagaaggatatgaactatttgaaacattcgcaactactgctctccttggggattcctaccctccttccattctttactcactggcctcatggtagagtaactagagcagaaatgcagagcgagagagaaacaaatatgcagctttcgaaacccatggcagagacaatagtttgagagtctcaaaatcttgcctttcgagaatccgagtcctgacacacagaaatcaggaggactagtgtatggtttgttaagctactttttcccacctacccagtctacattaatgactccctgagcaaaaaaaaaaaaaaaaaa

SEQ ID NO: 280 - DNA, 1990 bp, Homo sapiens
cagtttgctgtgagaagaccagaagggttaaccaacggcctcctgtccctggacgggtcttggtgcctgcttagaacccaaagcccttaacttcatgctcctcgtcctgcttcaggggcggggcttggcacaatcccaggaggtgccaggtctcaatggcccgaggccatgggtgggtgacagggagcaggggcctcagaaccaacctagggtatctggggccccccagaccagggccagtcctggggcacctgtgggaagccagcagctaccagtccctcctttctcctcagccatttggtgtgtggaggaattcctggggtggccttgagagaagagcccgtggtgtggctggcccctgtccctgcgaatagaaaaaccagtcctcgaggggggccgtgctgctgccccacaggtggttgcaggtagagggcctgagtcagacttgaacctgcagcattcactgtcatgggctcggatctcacccctgcctcttgcccactctgacatggtacttccttcctgggccttagtctcctcatctgtaaaatggggattcaaaggcccggcgggtgatgagatgaatttctgtgggtagaacacttcgagcggtgccagcaccgttacctgtgtgtgtgtgtgctggtaggacagttgttcccagggaccacactgaggccggccttggggccaggtgcccctcggcgtccccaccttcacattccattctgcaggccccccggacagaccacccagccccgtacagggacctgctgaggaccagccgcgtgcactggattgcggaggagcctcccgcagcactggtccgggacaagatgatggagtgccacttccgattccgccaccagatggcactaggtgactgacgggagggctcctgaggacgggccccttgaagctgagcttcctgaggccagatttgggccagggatgggagaccctggggtaggaaagtcccgttgtggagatcatttggagattacctaaagtatttagaactcccgtgtcctgtgcctgccctgagcgaggcctgggggtgctgggagcagatgcaggcaggccccggcgtgttgggctgaagcaagtgtgtacactgccccgcagtgtcctgctgcgtccagggcccaggctggtgccctgcccttcccctctaagcaggggtttttgaccccgtgggctggtgctcctttctccctgggggcctgaggtcgaccaggaaaggcctgtgccccctccaagggcccctctcttctacccagtgccctgtgtgctgaccctcaatcaagatggcaccgtgtgggtgacagctgtgcaggctgtgcgtgcccttgccacaggacagtttgctgtgttctacgagggggacgagtgcctgggcagcgggaagatcctgcgactggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaaggaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaa

SEQ ID NO: 281 - DNA, 1766 bp, Homo sapiens
aacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaaggggcctgtggctgcagttcagaggagaagaaggtcagtgtttggaggtgcagcctcaggatgctgagaaaggaaactggcgaccgtgagaaagaaaagagccaagcagcatcctggttcttggacagcatctttggacactctgtgaagggcaacgatcctgccagagaccgtctctctacaactgatgacccactagggcctggggttaattgctcaaagggcccagtgttcacaaagccacctctgccctaacccttgccagagctctccaactatgacccacgagaggggtgatggtgggattctaacatcaacagagcaaccagaaagacattgggcctcccacactcaggctgcaggcccactttcttggtccttatcagctttaatatttattaatgacgacataggagcccgagtcagctgtaaaggccattaacttgcaatctggacaggaagttgacgctcaccactttgggtaagagctgctctgactgtagggccccctatttgttgtcctaacccagaagcagctctgggctgccaggatggtggatggaataccagagagttcacactagggaggaagcaatgtccgccccctggagtctcctagggggcagcagttagaataagggaagaggatttgctggtcactgtttgctgacatgggtttccatggtgagttcaggcctgaggacagcagtgtctgcaaaaccacatggcccttgagaaatgtccttgcacattgggcttcaaactcctcttctagggaatccatcttggcctgaaagcagaggtacaacaccagccccaaaggcaattctgttttcagattggttgctctggaaaggaaggctggggtgagggggcattttacttgcacagaggctgaccctgcctcccctcttcactgaccccatctccaaggtagacctcagccatgtcggtccctgttctgggaggtgctgggctgggccacagccagggttatgtaggtaattaacctgtccaaccctgagcctcgcctccccacaccagcaacacagtggtctctctgtggtgaccattcacagcataacattctgcttagcctcaaactgaaagcattgcaactgatgtcaaaaccagatgagatcttacagggagagagattgggtgcaatttgcctctttctttgaataaaaagctctttgctcaccctcaaaaaaaaaaaaaaaaaaaaaaaaaaaaa

SEQ ID NO: 282 - DNA, 2681 bp, Homo sapiens
caaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcaccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatacttatttgttgtaaatagcaaatgctagacttgaatattatattaaaatcctgtttctactataaaaaaaaaaaaaaaaa

SEQ ID NO: 283 - DNA, 2262 bp, Homo sapiens
tgtttttgatggaattgattttccctgagtggagtgctgggggaaggaggaggtccaggccggtagtggccattcgccgtgcctcagcgagcaggtgtgtgtgggtcctccaccactcacctcttggttagcgggagtgtgctgcccccacccccacccccgcacccccattctacacaaggcagaagaggcacgggttttcctgggagcgaatatcaagtgcctgagagcaactacaggactaactgtgtttgggttgggtgtagtataaataataataatggctaatatttcctgagcatctactaaatgcaaggaattgtgcttggtgtgtcatgtggattctctcttgcatcttcatgataaatgttattgtcgctgttttaccgatgagggttggattagaggggttaaacaacttgtcttaggctccacagctgggaacaagtggggctgggaagctgacttcgtgctcttcaccaccacaaaggatgtgtgtgcatcctggggcatgcctgcctcatgtgggggtgtcctgggctgaatttcctgggcacttctcagtggaactctctagcctcctggttcggaatgtcaactatgagatcccctcactgaagaagcagattgccgagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagaggtagagaggcctcagcttctcctggtgggggtgctttgcctgtgttccccagctcatgacccttctccagttgtcttgttcccatataacatttgaactctttacacacctgaacctgtgggggccttgcccatttgaccatgtggcccaggccaaagcccagtgttggccttacgcatggtcggcaggagagtcagttgtgtgctctgttgaagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccaattccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgtagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctaccaggcgaaaaccacagattctccttctagttagtatagcggacttaataaaagaggaaaaaactcttgcttcagtaaaaaaaaaaaaaaaaaa

SEQ ID NO: 284 - DNA, 3478 bp, Homo sapiens
attttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgcatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttccttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttccggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagactttctgtttttaaaaatgtagcacttgactttttgccaggaaaaaaataaaaattattccgtgcaaaaaaaaaaaaaaaaaaaaaaaaaaaaaaaaa

SEQ ID NO: 285 - DNA, 1562 bp, Homo sapiens
aaaccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgttcactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggagtcccatcccccaaggcacatttttttttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccggaaaaaaaaaaaaaaaaaaaaaaaaaaaaaaa

SEQ ID NO: 286 - DNA, 2335 bp, Homo sapiens
gggctcggtgcgactgcgcagctcctcggcgcttcctcggtggcttccccgggtcgagcaaacaggtaagttcggggagacttcaggccagggcagtctcctgtcttctcctggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaagcaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacatgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactaaaaaaaaaacaaaaaaaaaaaaaaaaaaaaaaaaaaaaaaaaaaaaaaaaaaaaa

SEQ ID NO: 287 - DNA, 1135 bp, Homo sapiens
taattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaatttcgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaa

SEQ ID NO: 288 - DNA, 1863 bp, Homo sapiens
gagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaaaaaaaaaaaaaaaaaaaaaaaaaaaaaaa

SEQ ID NO: 289 - DNA, 2993 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcagttaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtaacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaaaaaaaaaaaaaaaaaaaaaaa

SEQ ID NO: 290 - DNA, 1198 bp, Homo sapiens
aaaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaggcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgcaaaaaaaaaaaaaaaaaaaaaaa

SEQ ID NO: 291 - DNA, 2751 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagattggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgtatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttaaggtaatggatgtttgcacctgaaaccactataaaaatccagggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcatttcggtttcagacttcaaagttgattaataaatttaatcttaacttttaaaaaaaaaaa

SEQ ID NO: 292 - DNA, 2504 bp, Homo sapiens
gattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgtccagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcacagccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctgggctggaggctgggggccttgccggagcggcctgaggctcctcctgagtactcggaggtggtagccgacactgaggaggcagccttggggcagagccccttcccgcttccgcaggaccccgacatgagccttgaagacccgttcttcgcctacatccaagagttccgctaccgcccgccacccctgtactctgaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagtgaagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgggaaaaaaaaaaaaaaa

SEQ ID NO: 293 - DNA, 3141 bp, Homo sapiens
ttccgaattctgtattaactttaccatcaaggcagacctcagctgtaccatcacagcagtatgccacgcatactgacaaaagacctactcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaacaccaacagcaaacagccttttaacggtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcgaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacttgcagctggacaaagtcgtgattctgtgatactggactctgagaaagatgatatccactgctgtgcattgggctggctctccatggtttacgaaggagtacctcagtgtcagtgtaattccatcaagaactcatcttcagaggaagagaaacaaaaagagcagtgttgtcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaaaaaaaa

SEQ ID NO: 294 - DNA, 2044 bp, Homo sapiens
taggaatatgctatcattgttgacttgttcttccttaggagaaggacgattttcacccaccctttctgttctatggtggactcttaacaggtgctatgtgaccaggaatctagccgggagtagcagaggccctgtcttctgaagtctcaggcttagaagttaccaaagtgggctcagaaactgtcatctcctggttccaagttcgggctctggcagcccagccgctatcttagctgtctttcccagcggtgctaagagtggtctcagtgagaaggtagatgccaactggagggccagacctgtgtcctgcccatgtcctccttggtggacgtttctgtttactcagagctgctagagaccatcctgcccatccgagttctgagattgggactgtgatgttgggacctgaggactggatggtagaatactggggtcccccagctcttagcaggatgcaggctattgcttccacacccctggccgtgagaacgtggtatgtaggagagttggctgtagctttaggatttctggaagccaatttggcatggcctatttgatctctggcttgtgctcctgctacactgacagactgattgcgtggctctttcagaagacccaggaagggcagctccagccagaggaccttcctggctatgcaggtgcacagctcttaggcatcaagcaaagggtcagccagtcagtagtagtgggaggaagcccttcctcctcttatgcaagcagctcgcagccagcccagaatctcttatgcagcccaaagggcttcttgaggtagagagccctccccagtgtcttcccaggataagtagaaatatgatcacagagcaacggagcaaaggctttcgggagtgtgaggctgcatctgctggagcaaagggaaaccgtgggcttttccggccagatactcttaagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttacttttctcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctgcccccgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaagttacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgt

SEQ ID NO: 295 - DNA, 2825 bp, Homo sapiens
gatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcttgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgacctac

SEQ ID NO: 296 - DNA, 4270 bp, Homo sapiens
ggaaaagaagacaatacaaataacttgaaaaggagtatgaactggatatggtcagagagacaaatcacatgttccatgctgctttaattggaaaacaattctttcatggggttactttcccttcagctgagataattaagtctggactgacactggtgaccagctactgatgataaatagtcagttactaacaatgcagcaatcagtaatcaaaatttatgtttcccaggttaccagggcacagttgaagagaaaagtgggtttgataaggctgggagataggcttcctcgtgcagtattcacatggcttcttctccacagcatctgggtgggatcattaggtctgctttatttcaaccttgtcataaaagaaaacatacctattgtctgtgtttgcattagaaatactttgcacgccccatgctggaaaagaagtttctgtatgcctccctgtaatttttaatggattaaattatattctgtaagtgggttggcatgagggtaggtttcaatgtccagttgttattggacatgaaataaacttagatatttttaaagccactccatgcagctggcacaagtaaaggtttttgaatcatggctaattatccctggctgtggctgaaggcattgaaatgaaagggattaggattgtaatatggatgccatttgtatttgtatcagcggctccgatatttgtctactcactagaatcacctggggttctactaaaatttttcacagcccaggtcacacccaagccacttaagtcaaaatctctgggtatggaacacagacatctttaatttttgaagctctctaggtgattccaatgtgcaggcaagtttggaaagcactggtctatactcagttttatgcatatttttgcataaaaatatgaaactgctgtctaggccgggtgcagtggctcatgcatgtaatcccaacactttgggagactgaggcgggtggatcacttgagcccaggagttcgagaccggcctcggcaacatgatgaaatcccgtctctacaaaaaatacaaaaattagctgggcatggtggcgcgtgcctgtagtctcagactcgggaggctgaggcaggagaatcgcttgaacccgagaggtggaggttgcagtgagcagagattgcatcactgcactccagcctgggcagcagagcaagaccctgtctcaaaaagaaaagaaactgctgtctcccaccccagtaagaccttaaaccccaagagaaaaagcataatgtgacccacccggtgagaaaagcaacctcaaagtggtcaaaatagactcagctctgaggagaaggagaaccaaaaaaggaggaaacatgcctttgctcctttcttagtgcttagctcagtgttagttgaataaatgaataaaaagagaaaagaggaggtggtcatgtgcagctcagttcccagaaagggtactgggatgggatggaggaaactcattgaccacatccttgcacagtgggcacctctccacactgccctcctcgctctcctgatgaattctttcttttctctctagtttagtcaatctcctgtcttctctgggagcagtcattctgagatggtcgaagatgactgtctcaggggaggacactcattcagcttttaaaatgtcaggtgtcctttggggatgcttcaaaagcagcatttgggcttcctttgccataggaaatgaacaggaagaaaggccagtgaagacagagaacaagggggcaggtgcctgcccagaaatcaacgtgcagatagagaagggagaaaaaaaaaagttcccatctgcagtactggaatcccacttatggagcataaaataaaaaatatgaaggttatttgctttgagctcatctgattctttgtgttagactgcactgtggcctgcctttctgagtttgctacatttttatttgaaagctaataaattagccattcatatggcacgcaggcgggtttatagtgctgtgtaaaccaccagccaccatatacatccatctgcatcacagatcgactagaattatcactactgacaccacaatgcctataaattccctcacccgcatcctgtattccagaatatttctattggctgaccatactgcgaagagacgggatcctgggaaaaatccttttttctttctagtttagtgggaactggcaggttatcagtaggtctaagctctaggtttgcctctagagacaaagagtttaaaaaatagtaactagttttattttgttctaaaaaaacacatgcacaagaaaaatattgtcaataaaacataaaaatgtacaacataaaaagtgagtttcttacccaaatctgacctcctacacctcctccctcagagacactgttactagttgcttatatatgagaactgcaatattcacgacactttaaaaaatcagtcaatcttggcttgtatttcaagtttcattaacaaaaaacagccccctttacaatcactggggtactgaatgcactgatatttaaaaatacccaaagctatttggatcaaaatcaacaaatatttaataagtaccttcaatgtgcacaatgttgcctaaacaagccatttctaatgaggattttacacatatatgtttcatactttttttctggtgtataacaactaatctaaaattatgttagtgaaagggtagtcagtctttgttttaaatgtttttctcagaaacaaaaattatctctttctctccctcacccctctaacttctcagcctttcacacattctctcatttgagttctgttttacgccgagacatctgggtaggtggtatgttctggccagagtactctctctcataccttccccagatggattggctcaaggatctaatattccccaaagaaataaaacatcccccaactggccattgaagaagagctgcagtgctttctattctaaacacacatgtgttgaaggatgagagacggtcatgacagagccagtgtccccacccatgacttgtctgcagagggggagacttccagtctgtagcccactgcaggatactaggctgactgcacagccccgttacccctcaaactccagccagctacatctgtatgtcttctctccagctggctggcccagctgttctggtgtcaaagaaagttatgagtcactgggaagggctttgagacaagagtagagttaaaccatctcctggggtctgtgtgtcattggcaatcgagccttagtaacaagccagtgcttgacagtcccaggaaggccacacaaccagagcttcactttgtattccacaatccacacctctgggctttgtagtgaaaaagaggtagagctgtatagatgctggatgtctccatccctagagactttctgtcattggccatgatgttcattaggttcttgccatctgtctccttgcaaatgctttttggctgtagatctatatcctatacaatctggtcaaactgggagacaatgaatgaggattggccaaagcctgaggactttcttttggtcttttgattccagggacattattacaacagagccctaggagcagctgccagcaagagtttgagtccacagcaggatccttctggaccatctgtggcttcctgctctgaacagtacttcctcactacgtgggaggaaagacttgtcagaggatccaagaaccataggcagtcaggtcctccatggggaccctaaatgttgtctggtctagccctgcatcctgcgtctaaattcctggagaacattccttctgtcctagcactcatctggcctccccatccccttaggtaggctagtccatgtgtgtgttacaggggctgctagaaagttcctccctattttgagcagaaatcatctttatagtttctacccattgatcttaggtctaccctcacaactgtcctctaggtttctcttcagatatctgaaaaatgccagtctctgccccttgcatctccccttttccttgttttagtactgatttttcagaaattgtcctgatactctttttttagagcttcattcactatttaatgaatatttgttaagagtttactgtacattagactttgttcttgaatgggagggatacagtgattaataagaccaatttacccacatagagcttacattctagtggaggggaggaacagacaaaagcaagtgaaaatctcaattaggaacaaatccattgcagaaatgtagaataaagtgatgaaaaaaaaaaaaaaaaa

SEQ ID NO: 297 - DNA, 2144 bp, Homo sapiens
cagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagcagccagaataaagataaatgaagaattcaaaaataataaaagtgaaacttcttctaagaaaatagaagagctaatgaaaataggttctgatgttgaattattactcagaacatctgttatacaaggtattcacacagaccacaatacactgaaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaaatgcaattattacatttaaattgttagattaaaatgatatttagtcctgaaaaatattaaattggtcaaaaaaatcacagtgtatgccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaatcggtggctacattctcatcgttttaattaatgaaacttaaatggcttctcttcttccacatgtcctgtccttgacaagatgggcagtatcacaaaaggtcctggcattctaccatctaacactaggaactgtaaaatactgtttaatattcttcttgtttctcttttatctgtgtatctttgccattctattttctcagtgaatagtatgttttctcccattcactgataaattctctcatttgatgatgatacagggtttttaatttttgcaagattctcaatgcaagcattgttatgtatctagaaattatacctagagaaaaatgaaagtcgtttcaaatttgaaatttgcccttttaagagaatgctgaatgtcatcgcagtatataatcactatataaatgtgctgacttacagttattttagtgtctatatgacatattttgaggaaagttggctgacgttatttaaatttaatatatattctatattttagtgttattgaatattttatcactgagcttttttctttaacctgaattccctgttccatttttcattcatattaatttaaataactccagatttctttcttatagtcattattagtagcagatgagattaataattcacatgtttattaaagatagtggcttagaaattttaagatatattgatataggcccgggcgctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgaactgagattgtgccactgcactccagcctgggggacagagtgagactctgtctcaaaaaaaaaaaagaaaaaaaaaggaaaaaaaaaaaaaaa

SEQ ID NO: 298 - DNA, 1589 bp, Homo sapiens
ttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcggtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccaaaaaaaaaaaaaaaaa

SEQ ID NO: 299 - DNA, 1939 bp, Homo sapiens
ttggcctaggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggagttaaaaccgtttctcagattatctccctccaaactctaaagaaggaatataaatcctatgaagccaagctccgccttctgagcagttttgatttcttccttactgatgccagaattaggcgactcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccaaaaaaaaaaaaaaa

SEQ ID NO: 300 - DNA, 1973 bp, Homo sapiens
ctggggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcctaggtttcttttcctgtccctcttccatccccaagatgtgaccccataaaaattttccctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttgacaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggtatgtgggtctgcaccttgtcccctcataggatggtaccaagcatttagtgcacagtggccccatcatagcctgcagcttcatcatttcccatctggacctggtacaaatgcacgtcacaggctcagctcctccccactagcatcttctctaccttcaagaaccaggcagccctgccatgtcacgataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgggcttattaaacacggaaggcaaaaaaaaaaaa

SEQ ID NO: 301 - DNA, 1644 bp, Homo sapiens
gacacctcttgataaaagaggcctttgctcacatgttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcagcttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccatttgacttctttcctttttttttttttaaataaaaaaagtgcttgactggtttcaagcttcatcatgaaaaaaaaaaaaaa

SEQ ID NO: 302 - DNA, 2570 bp, Homo sapiens
attaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattagtcgaaaataaaggttgatttagaaatgaagaaaatgaatatatttcttaatacaaaataagtgggaaatgagaagttataccaataaaaagcatttacaaatttaggggatattgtaacccagtataattttctgacaggttggactttgaccctaatggacttactggtgaactttttcaaatgtttaaataatgtctatccatgtatcatgaaggacagtatgcttcaaattgtcttttgaggcagacatgttctcagtactaaaagacatttttagaaggattttattctcaacagatgcaaaatgcaaaataaaatattgacaaacaatacagcaacaaataatttactatcactcaggattataaggctggtgttaagcagaacagccattaaatcagcatcaaaagaacaaatagtaaaatccaaagtattaattacagataacttttcaaaaattcatcattcacccttgatttaattatttctctggcaattatttaatagacttctcggagtctgttaagtacttaaaccaagaactaccattattcctactgggaaaacataaacatttctcaagtggaaagtaaacagtgttggcactatttttatatatggttaaagagacctgtcattgcaataaaagccagcattcacaaaatgaggaagataaggaaagtagcataaatattttctattaacatggctttacaactgctaaaacttatagtataaaaatgtactaacaaagactaattcaagaagttgcaggatacacaatttttaaaaatctcatttctacatcttagcagtgacaaactgcaatttaaaaagtgtgtttggttattaatatatatgagacttttaaagaaagttatataactacatagagataaattaagaaagatgcctaaatagaagcaagtttaaagagctatatttttaaacatgaacaaactcccatgggagccatgccagtgtagtggaaaagtagtacatggggagatggggagtttttttgaaaaccagaattacagttctcatttcactacttaccagttgtatactcttgggaaagtcactcctagtatctatttcaccatctacagaagagaaatacttcacagaattattgtggggattaagttagataatgtgttttaaaatataaagctacatccaaagaaatgccaatatgtgacattagtatgaaatttactacagttccatttaacattccaactggttgctgtgtggaatatggcataattgtaataaattatttaggaaagcaagcaaagatgtaagtttttttaatttagggggaaaaaatgggagccttgctctccaaatccttaaaacatgctattaagcaacctttctgaatattctgtggtgccaagtagaaagtttaactgaaattaataagccaatggaaagaaagaaatattaataactgctggtggaaagactagctagatgtcagtgtggaaagattagatccactttacatgtgatattccaaatgaattaaaatgttaagtataaaaagaaaaatactacaagtctcacaccaatagtggtataaaggaacttcatggcaattggcaaggtagatcaactaagagaaaaagttttaaatgtgtagtaaataggaaaaagacaaaacaagatggaatttaaaagaagctatttgcattacacatggatgcactcagtttttgtaaaactatatgcatatccataggggtttgtactcttaggcaaatttataaagcgatcgtgtataaatgatataaaaaatcaatttgaatggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggtttactg

SEQ ID NO: 303 - DNA, 1628 bp, Homo sapiens
gttacttaagaactctttgtgtccgtccttctaatggcaccaatgcctcccatcaagccttaaacctcacctaaattatgtcattgggctttttcatccataaatgagcataccaggtgccaagggaatcaatatgccatttcacatgccttagaccagtgtccaaagaaagataaaatgttattctataaaagctttctcccagcatttctattcctttacattttgtgccatatacaactatggttttttaatgatcttatttctgacagctgtttttcttcagaacatcaacagcttctttcctaaattagttttagtatgagttccatttctaattagctcaaattaaagtcctagagagcagcgaggtaatatttaaaccctcaggctaaaatttcggagtaggtgcagaatgttgactctaaatgagtttttcctgtgacataacacgcatgaaagcaggatttctttcatgtgtgaaatgtcttaaatcagacttaccctttgtgattctcttttagctttaaatgtcatttaagaagaaaaaagaaaagaaaattaagcatgacattccccaatatcctctgctcactgtgttataatccctatcactccacaagtgaattggagagagtgaagacacaatgaacagaaacttccctgatgcttcacagaggaagtgttctccgggaccacacagcctccaccatgtccatctacgaagggctgtggcaagccatatacacaaagatgcctgtttcctgtcttctcggttaaaaacaaaaacaaaacaccggaaaaagccaagctgccatgggttgcagagtgccagcccttaagtagtgttgttcatgggtaaacaggagacggataagggcaatttcaagaaataacaaactcaaggcatgaatgtggttatccaaacatcaagggactccttcatttgcatttggataattgtgcagttatatgatttgttacatggagaccagatggaagtaagagagctcatcctcaacttcctgtacctctggaagtctttacacacatgctggagagatagaggagagttcattagcatcaaaccaccatggatttcataatcaattcctaatatctgaatagatgcagaaaagtcacaggcatctagaagtgtggcccaagttctgttcttcaatcagcccacccattatccctatgtatctcgattttgttatctaaaagatcacatgatggaggatgtaagcaagtaacacagccaagacccagtttacagtgtctagtacctaacagactcttgacacgtttcacttgcccttgagtcagtctttccatgtcactgaatattcttccacaacacgattttaatggatatagtcgtccattgtttaaatgtaccattattgaccaatgtaaaaatgttcttttacctcaaatttttatatgtaaaacaaaaacatgtttgaggactaaacccacagtgtagtataaattaaactggatgtaggccaggcatggtgagtcacacctatagtcccagcactttgggaaaccaagacaggaggatggcttgaagccaggagctcaagagcagcctgggcaatacagcaagacctcatctctac

SEQ ID NO: 304 - DNA, 1341 bp, Homo sapiens
atgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagc

SEQ ID NO: 305 - DNA, 1798 bp, Homo sapiens
agcaaagagccgaggccgggcgcgcgaccctcgtccttctgcccctggccgcacactttgcgcacatctctttttctgcatggtggatattatttttcattatccttttctgggtgctatgggtgatcattccaagaagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactacgtcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccgacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcgggtcatccgcgtctggttccagaacaagcgctgcaaggacaagaagaaatccattctcatgaagcagctgcagcagcagcagcacagcgacaagacgagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgtccccatctcggccggcccggagctcgcccacgcggacccccgccctgccccagctcagcgctccctggcggcttcgcccgggctcctagcggggaaaaggaaggggataactcagaggaacagacactcaaactcccaaagcgcatgattgctgggaaacagtagaaaccagacttgccttgaaagtgtttaagttattcgacggaggacagagtatgtgagcctttgccgaacaaacaaacgtaagttattgttatttattgtgagaacagccagttcatagtgggacttgtattttgatcttaataaaaaataataacccgg

SEQ ID NO: 306 - DNA, 1806 bp, Homo sapiens
gaatagaatgaaatctcagtaatgaattaaagcaacaaaaagatattgattggcaaaaagcaagatataagagatgcatttgcttaacatctctacataatatttatggtctggtcagtattggtctggtcagtattgcctggctgacgtgaaatgtaaactagtaggcatgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacgaaaaatgaaattcttccaacagcagagaaactctaaaaagtttgatagtacctatcaaagtgctgtacttctgtgatagagaacatctgatgtaccaatttagatctatttctttatactttttctaaccaattgcttaatagtactttggatgattatcacctttgccacttaaaatatataaatatcctttttacttcatgaggaaggaggaattttttgattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttacggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaatgcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtgg

SEQ ID NO: 307 - DNA, 1649 bp, Homo sapiens
atagaaaattagaaaagcagagaattcgagaagagaagcgagaagaacggaggaggagagagttagaaaagaaacgtttgcgggaagaggaaaaaagaagaagaagagaagaagaaggatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagttcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgtt

SEQ ID NO: 308 - DNA, 1298 bp, Homo sapiens
ttttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcctgaacccgggaggcggaggttgcagtgggcctggatcatgccactgcactccagcctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacgagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagatt

SEQ ID NO: 309 - DNA, 1411 bp, Homo sapiens
aaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatg

SEQ ID NO: 310 - DNA, 1844 bp, Homo sapiens
tccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccat

SEQ ID NO: 311 - DNA, 1407 bp, Homo sapiens
atttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgatttcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaat

SEQ ID NO: 312 - DNA, 3086 bp, Homo sapiens
taccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttacccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctatttgtttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttcctt

SEQ ID NO: 313 - DNA, 2372 bp, Homo sapiens
cgataatgactttgcacgattcactttgggatctcaaagtgcttccaaagcattcagatttacaaacaattcacaagacaggtcatctttgtaatacccatacttacaacgaattaacaagaggagtgacttaagattctccaggaacacagtggcagctattgatgatctgttttctatctgtttgatagagcatcatgagaaatcacaaaatacaatgctatttttctgatgtgtgctaataaagtcaaagaaagcaaatacatcttgacacttttgtccattttcattaaaaaaaaaaaaaagttcagggtgtttggaattttacacctcagcacaccttactggtatcaatggataaagcgggtaattgacagatccacccaaatgccactgcagtcagaagcagatctggacacacccttgtttacagtttcatattgggttgctatagttcccgtgctaaatcaccagctttcaggaacatgactgctcctggcagtggaaggtgctgaaacagaaattttaattaaaaactttatcaagtactcttcacagtgctgcttggcaccatagaaaatcagtacaatatatcgagccctactttggaggagctggatttctgagggagctgatccagttctaagtgtcttctcgaattaggagatagatgatctttgatggggatctcctccgtcaccacaggccagtcacagaaccaactagccacgtgctgccagacctcagtgggcccaagcaggagcaatctcttctatcccccatctcccccaggaccatcccccccattgtcaatgtcatccagggctcttctggtagtgagtgacttttctgcacatgtttagggcttgggggagctagaacacaggaaacatgaatgcaaaaggcatggaaaacactgttttgctttgggttagtaaaatgtgggcaggacaaagattactattggtcggagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccgcaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctctgagtgactgaatgtgactattgcattagggtaaatgaattaagacgtgcaagtgggatttactgtatgttagaaaggagttttgcagccaagactgccttgaataaaatgtgtttgcactgaaaaaaaattttaaattacttggtctctggttgctgtaaaggtcatccaagatggatgttctgtttatattgtatagtatttcatatgaaataattacagttcatgaaatgtcttccctaatgttactgatttataacagcacatttgtaacatggtttttatcgtgtcagtgtaccatactgtaaatgatgattacttgtcatgcttagtataataacttaaaagaaaaaaaaggacagggatttttgtaagtctatatttgaaagtccctccctatggtgatactgtgttcatgttgtttatgtagtgttgtgtgaaatatccattttggattgtgttactttttaagatattaaataacatttggtt

SEQ ID NO: 314 - DNA, 2467 bp, Homo sapiens
gagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaggtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaaggtgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcagaaaacatgagtttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagttt

SEQ ID NO: 315 - DNA, 3296 bp, Homo sapiens
gatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaggaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttccaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatataagtagtcttctgttagaatcacatctgtgcttttcttgagtctgccgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtgatcccagcactttgggaggctgaggtgggcagatcacaaggtcaggagtttgagaccggcctgaccaaaatggtgaaaccctgtctctactaaaaaaaagaaaaattagccagacgtggtggcatgcgcctgtgatcccggctactcaggaggctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactggacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggagcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaggccatccctcctgcctcagcctccccagtagctggaactgcaggtgtgtgccatcacacctggctttacatttttctgtggggtcttgctatattgcccaagccggtctcaaactcctgagctcaagtgatcctctgcctcagcctccagagtatctgggattgcatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtatttttttttgtaatgactgaaagctgttctgtggatgacctaccctttcctttaaacacgattctctcacttccaactccaaacttgctcaactaatccttaaaaataaacttgagctggaatttg

SEQ ID NO: 316 - DNA, 2421 bp, Homo sapiens
gaaaaaaagtgagagacctctgcctacaaaacctcaaaccagtcacttttgtcaattgctaatacccagttacttatgatttaaaaacaaccaacagaaaacatcccactgactgtatggcactctatagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctataggaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatg

SEQ ID NO: 317 - DNA, 2593 bp, Homo sapiens
gtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaagattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaagacataccccttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagggcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttg

SEQ ID NO: 318 - DNA, 2635 bp, Homo sapiens
gcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgggtttgatatgctggtgaagaatagaacccaaggaatcattcctttggcccccatatctaaatcattgtggccttgctcagtagaatcttccatggaatattgtagaataatgtatgatatatttcctttcaaaaagccggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttaccggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaggatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattgaaatatttgaaatgc

SEQ ID NO: 319 - DNA, 2451 bp, Homo sapiens
atgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacgtaaaggtgggtagaaggtagcaagggcaggggagaagagaacaggatctggagacactccatgaagactcttctctactgcagaaattgtcatagacctaatttttaaaaaaatgaatctgagggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcaccccccaccacgaccctccctcaacacctggggattactattggagatttgggtggggacacaagagccaaaccatatcgctgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagtttt

SEQ ID NO: 320 - DNA, 2182 bp, Homo sapiens
acttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaactgaattatttttctccaaattgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcatgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggaattcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctacc

SEQ ID NO: 321 - DNA, 2449 bp, Homo sapiens
tatatgtgacctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccagatttggtttcagaatcaaagagctaggcatggattccagaaaacaccagaacctgactttagatttaagccacagccatggacaagattaacctggtgtggagtttcaaaatagagaagccagatggtgttgtaccacctatagcacctttcaattacacacaatcatccatgcatttatgaaaaacccataccctgggattgattccggagaacaacttgctgaagaaattggtgcttcagagtcaagagtccaaatttggttccaaaatcaaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacagtcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaaaaggaaaatcagtaattttgcagtggagacatatggccaactccaccttacccaagtggctgaaagtcactgcaccagtaatggcacaaaccaatgtgagatgattcctgatatgatacactaaaaagggcactgtctcttctgcatgttgcagacaaaaagtgggtaagctgacactgaaactaataattaggcaatgtcaagcaaatacaaattcaagttgacagtctgcaaagtaacatccatgtactcttcaacaatggatcgaccctagctactcaggaggctgaggtggaataattgtttgaggccaggagttccagatcagcctgggcaacatcatgcgaccccatctctaaaaacatctttttaaaaatgagccaggtgtggtagcatgcacccgtagtctcagctactcaggagcctgaggcaggaggatggtttcaacataggagatcgaggctgctgtgagctatgatcgtgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatacctgtaatcccatcactttgggaggccaagacaggttgattacttgaattcaggagttcaagaccagcctggacaacatggcaaaacacgtctttaaaaaaagaaaagaaaaaagaaaaacagaaagaaaaagaagaaaaactacttgctgcccttacttgaagctcaattatttaaaac

SEQ ID NO: 322 - DNA, 2622 bp, Homo sapiens
gaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatcttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaacgcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcgtgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacttcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgggagagctcatttagaagtcagagcaaactagggtctcagtattgagaaacgcagcctgccagggaatcacagagacatcggggtgcccgtgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggt

SEQ ID NO: 323 - DNA, 2625 bp, Homo sapiens
aatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaacaagttgattttttttaggtctactattgattgaacattctccaatgggcaaggctcattgtcaaagcagggtgaacatgatcagattttcttctgcatcatcacacaagctgcgagtgttgctgcaaagcacttctcagtactccttccctaacctcagtatgttaatagccattaatacttggcttaagcatcaccattctggccacagtctgagagattagtgatcaaagctcccttccctatcactaccaccacctactgataacaaagatttctgaatacttagtagtagtaaaatatttttcaagcacagagttacagctaatcctggatcacttgttctaaattcataagggagtatatcaagagcaaatgaagtaaatgattctttcctgcgtgtgggagtcaccatcattttattcaaagggagttcctgtgataggttcattccttaagtggtgctacagaaggaccctaggaaaatgctgatcttgtcctgagaggcaactgatttgagaaaatgattatactacagcaggaaggcagcaccagtgaacatatggtaaatggcaaaaacaagacagttttagaaactgctaattcagtagcagccttggcctttcccttaactcaagcaggctggaatctgtctttatagtcggcaactttccaagataaagcagtgataatagcagttggcaacactaaatatcaatatcatcaccctttaatgacatgttacccctttcagatctagaaaatcaggcaaaaagtgatgtcccaactctactctaaaaacctgctcctactattttagtcagtgtttctttaaggaagaagaggactatgtccccaaaagctaactctgttttatagccctggtggatccctgaaaaccctatttattctatactgggctttggaatatgaaaaatggacctgtgtggccgggcgtggtggatcacacctgtaatcccagcactttgggaggtcaaggtgggcggatcacttgaggtcaggagttcgagaccagcctggccaacatggtgaaactccatctctactaaaaatacaaaaattagccaggcatggtggcacacacctgtaatcccagctacatgggaggctgaggcaggagaattgcttgaacccgggaggcagaggttgcagtgagctgagattgcaccactgcactgcagcctgggcaacagagcaagtctctgtcttgcagcagggggaaggacctgtggtactcctacaaacttaacaactttagcttttcggggaacagtggtggtctccacagatagctagaatcttctaagatgaaaataaactgtttcatccagctgctttctgcctgttaacctttgccacttccattccttcaagtgtgtaatccccagggttgtcttgtattacacacatccttgttaagtaaatataccactgttgatttcttcttccagtgcaacatttggattaaataaaaatctttagtttccag

SEQ ID NO: 324 - DNA, 3179 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctggtattcctaagatccctgagagccaaggcccaaccaggatctctgccttcccccaccagaatccatggtttggcagccctccgccccatcacttcccaccctgggggatcatccagagacttggctcagggggaggtgggaagggggcagagacacatccatcctgcatttgtgcctaaaaatccctccctctgtaccagctgccactctttcttcccgggtcctccccaaccctcctccattccatccccagagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaacc

SEQ ID NO: 325 - DNA, 2624 bp, Homo sapiens
atcagatgttgggacccttaagtgttctgcacctggggagagttaggaaccacttaaggagtgtctgttgcttgccaatcttaaaatttttagtttgcacctgaatcaggggctgtcagagtccagactgctcttgaaatagaaaagactggtcgttaaaggcaggttcgttgagtctttcatcgttgagtgataccacctctgcagatggctcagtggggcagccccgtaccacagcctgcccttgaggttgtgtagtttagataggtcacagagttgctgggcctaccgcaggtctcctgaccctggtgcagttttacttcaattacaaccaccaaaatagctacagtcaaaaattccaaagttcctacaccatcaacctccaccccacttccgtccaaagtccacttagaggctctcagttttggaccttagaaacacttagggagctttttaaaaagatcgattctgtatttttagtagagatggggtttcacccagctactcaggaggctgaggcaggagaatcacttgaaccggggagttggaggttgcagtgagccgagattatgtcactccagcctgggcaacagagtgagactccgtcttaggaaaaaaaaaaagattgattctggccgggcacagtggctcacgcttacagtcccagcactttgagagactcaggcaggaggatcacttgagcttaggagtttgagactagcctgggcaacccagtgagaccccgtatctacaaaaattagccaggtgttgtgacatgtgcctgtggtcccagctactcaagaggctgaggtgagaggagcaagtgagcccaggagttcaaggctgcaatgagctgtgatcgcaccactgcactccagctcgggtgacaagagtgagaccccgtctgaaaaaaagattgatcccaaggccttgcccagattctgattttattggcctggagtgtggcctaggcattagaaaatcttcaagagagtctaaggtgcagcggaattgagagccacggacagaagaagccctaaattgtggaaatgcacagccaccgtcaccacctatcggtacgatgacatctcaaggagtcactggccctaggtttctgcagtaggatcttaagatctgatctctgccctcaagtgagtgcacgtgcagtaaagctgtcatcgtgccatgacagatgtctgcaaggactttacagtggggtccaaaggatgccaccatcagctccacctggggctcaacaaagcctgaaagaagaaagggatgatgcttccagcagaaacctggaggcctgcagctctgccagcccagcacagcaagcgaggccatttgtccagcaggggcagaaggagggaactcagccagccagcgtttcctacaagcagctccatgagaggtttccacttaaaatgctaaatcataattatttaatcagattcgttccttaagttctttaagcagcatcgctgtcctaccacgagtggtcatcaaggagcagggtttaactcaactctgagttacccggcagggtacctgggtaactgcctgggttgaggtacccagcaggcttcatgtgcatgtgcacactgccccctgataggacctggtttattcacaggctcaggtgtcactgcagctccccagtgactatcttcgcgcaagttggactcaatggcctgggaggtttgtcccagccgacagatacctgaccatgcccatcctcaccattccctcccccatgctgcatccatccaaccttgatctccactgtgtcccaggcaccctaagatgcacaagctatgtgggccctgccctcacagaacttgtagtcttctgccccaaacaagccagttcaccgtcttcatgatcaggccaaaggttgaggtacccagcaggcttcatatgcacatgcacactgtcccctataggaccatgccttgcccagctggctgcactctagagggtgctttgtaggaaggacagagtggagaggacagtggggaggtacttgggtgttcaacagccagaagggagggaaactgaaaaagaatcaggagtccagccatcccctccccacctcctgcccccacttccaccctggctgctggccctttgcccttgaatatgggtgatataggtgtggctattcagttccagtcacagtgctgcctctatgtcttttgcaagctggggtcttccttactcagaaggcctggaggccctgccagatgctgccttccggactggctgcccgctgcagtgttttcacgggagccaagccagccccgggcctgtagcctcccatgtgacaaagtttcagacaccacagtcctcagctggaccacagtaaaacacttgccttccccaacccatgattcttgcttggaaacatgaacctgatgttccacgtgcgttcagccaatcaaacctcaagaatgtgattgagcagtgaggctgcgttttgggcaagacactgagctctgaaataagacttttcttggaatctcaagccctcaacttacagtgggaccctaagaaatgcacttcagtttccttttatgtaaaatggtggtaaaattaattgtgttcattaaattgcacacaactat

SEQ ID NO: 326 - DNA, 2833 bp, Homo sapiens
aattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 327 - DNA, 3174 bp, Homo sapiens
acagtcttccagctccacatcctgagaggacgcttctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcgggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgtacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactcctttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccgaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaagatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggaatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgc

SEQ ID NO: 328 - DNA, 3522 bp, Homo sapiens
actagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtttcagacacagttctaaaggaacgcctggatccagaaacactggaatcattagggcttatcaaacaatcacagcagttcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagatatcgtctgtatggccagtggaagaatgaaacatgatgacacgaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattggtgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgac

SEQ ID NO: 329 - DNA, 2196 bp, Homo sapiens
atgatggttggcagttagcttcctggagtgtggacgggtccttccctgcctgactgacttgtccacagggcagcaagaagatgcgccccttggtgtgtcccgagtgtctcctgtaggcagctgagctttcgcaggtctggctgggagccaaggttaccaatctggggggtaacccagccatcatctggatgagcgttggggtctttctgctctggattgcagggcagacgtcgttttgtgctggtcaggcccctcgcctgcctgattcccttggagccccccaagacaggagatgggcagatgtcctctgaagtggcatgggctgcttgctcactggccttcccaggaccctgcccaggtggtgctgcttggccccaggtcgaattcctgtgctggcagcaagcaggggcctgggccgtcggctggctggggctcatgcagccatcccctttgcagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggtgaggatggcacagtgacctccttggtgggtccccaccctcatggaggctggggaagagctgggcaggcactgcttcatcccagcgtcctgtccccagctgaggtgaggggggccagggtctggaggcagtggcctctttgccctgagctgactgctgatgtccaggggcagggcgtggcagggctgaggggcctgtcccaatgccacagggatccagcctgcgcacacctgctaagcccctccctggccctccccccaagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtag

SEQ ID NO: 330 - DNA, 1793 bp, Homo sapiens
ggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacaggtgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaaggagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggc

SEQ ID NO: 331 - DNA, 1980 bp, Homo sapiens
attccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagctgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagcatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgtaagtactcagaaccaggaggactagaagactccttttggccagataagactacgttctctattgcagcttctgaaccagagactgatgttgacacactttttttccatttggcaggaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatcttaaataaaccagagatctgatcttcaagcaagaaaataagcagtgttgtacttgtgaattttgtgatattttatgtaataaaaactgtacaggtct

SEQ ID NO: 332 - DNA, 1891 bp, Homo sapiens
ataggtatgaattcatttaagtcctgaagaaaaagaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttcc

SEQ ID NO: 333 - DNA, 3129 bp, Homo sapiens
agaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacaggc

SEQ ID NO: 334 - DNA, 2414 bp, Homo sapiens
gaacccaggaggcagaggttgcagtgagccaagatcatgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcctgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccaggctacctggctgtgcggtgagcctgggtgaggaccagggtggaggcggagggggtgtgtggaacgttctgagatcccctttaggatgaagggaatccggttccagagagtgaggtaggtgctagcagccacctgctgacctacacctgtcctttggtcacctctgtctgcccacctgtgccagtaaattcttgctctgggcatctaattccaaccaccttccccacaatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctctgcccaccgctccctcctgtctctccccaggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtg

SEQ ID NO: 335 - DNA, 1583 bp, Homo sapiens
actcgatattgcgaaaccaaacttggtataagagctcccaacactgctaaactggtcatcgctaaacctttaaaaaaaaaaaaaaagcattcgctggtacccagatttccacaggagttaaacatttcctgcgcagctaaagcaagtcttaccagtaggaaaccggaacttgctaggactaagaaacttgaggctaggctgaccccatggttgttatgattagaaatccgaggccactggaaacccggagctgctgaccaacgagtcacagggtaacttcgccttcgcatggggaaacgggctggtgcagtggtgtcatcttggctcagtgcagcctcgacttcctgggatccagcgatcctcccgcttcagcctctagagtagccgagaccacaggtcacccctcgctgccaggctctcttcccggtccagagcccacaggatcctacaggaggggccaacaactgcttgcctttgaaacttgaaactctcggtctaaggttccttaggagcgtaaaaggcacagcgttttctgatcgcagcttcaggtctcccgcccctgtcccggtacctctcctgcaggacggaactctgtgggaacgctcgttgattctgatggttaactgtcagatatccttgatattggacataggatttggaagagggcaggagagaaaaatgaactgcaagactccagcacaagaggtgggattgctggcagatgtctgctccctctccaaacctaatgaacatctcaaagtgccatccactttcctatacccttgatctgtgaaatggatcactgacgctttctctgtctttccggaaatgcaaaacaggtgaattttcaagcgcttgaattgtctctcacacttttcagtcaagagtggggctataaactccttcctcataggaaataaggaactgccactgcttggaagtaaaacgtatttttcccataagctttcacatttcccaaaaaaaattatacatccagatgtaatccccctaagaggcttacagaccctaccaggagcgttcccacgcgaacgcatcatctcccaatcggatcctgaaaacaccatgcaaccaattccatccttttctggatcaacctgggcagaggacaggtgcagaggagcccagagaagggccttgacaagtcaggagacccaatttggggtcgcaattgtcactcactccccaggcgtttgctttgatcttcccctcccaccatactacttcttctgctacctggtttctccctggtatttgaggatcctccaattgccttctggtcttacagacgggagaataaaggaaaaatggcatcgtttccaccttaaaagttacaagcacttcaccagatggtacagcctaggtagagcctttgtaaaacaaatgcccgcccactgcttcaccctcctcatttccacctcagcaaagcattttagcagaaaagctgacccagagcagtagctccctgctataatcctagcactttgggaggctaagtcaggagtatctctttagcccagaagttcaataccaccctaagcacaaagtgagatcctgcctctacc

SEQ ID NO: 336 - DNA, 2779 bp, Homo sapiens
aaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaagctttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgggcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtc

SEQ ID NO: 337 - DNA, 2154 bp, Homo sapiens
gggtcaaggtcgacggtatcgataagttttttttttttttttttttctctttgatacatacctaggaatggaattgcggggccatgtgtggtaactgtatatttaactttctgaagaaccgccaaactgttttccaaactctaccattttacattcccaccagcaatatccaggtgttgccatttctccacttcctcaccaacacttgttttccatttttgtttttgttcttattatggatatcctagggagtgtgcagtggtatggcattgtggttttgattgacatctccctaatgattagtgatgcagaacatctttttattttattctttattttgatttttaggtcattcatacgtctttagagaaatgttcagaacatttgcccattttttaattgtgttactgtttttttgttgttgagttgtaagagttctttatatgttctggatatcatacccttatcatgtaaatggtttgcaaatattttctcccattctcttgtcctttcacttttgtgattgtgtctgttgacacacagaagtttttcattttgaagttcactttatctatttttttctttggttgctaacgcttaagtgtcatatcaaataaatcattccctaatccaaaatcacaaagatttacacctatgttttcttgtaagaagtttatagtttagctcttaacgtacttagatctttgatccagtttgaagtaatttttatatatgtgaggtacatgtaaggtaggagtccaaattcattctttgatatgagatattatcccagcactatatatagaaaagattattctttccccattgaattgtcttgaattgtcttggcaactttgttagaaatcaattgaccatagatgtatgggtttatttctagattcttggttctattccactcacctaaatttctgtccttatgccagacttggttagttttgaatccattttttagttaaatattgacttattccctgcatttaaacttcataaatataaaaagcaatctgtgtagtgcagtacacaatgtaaaatgactgtttcattgctttgcaaattccatcttagaagttttatggttctgtaatgaataattgcttgtagaaatttattgaattaatcgtgtatcattgggaatttgccaaaggagactcagaaaatcttttgggaataaaatcatttaaattttctgaatgctgactcaaatactcaaaattgctgttggtatttaatgataacttttatttttcatcttctaagaaattctgagagaaaatcaggaatgaactatgaagtccttgtattcctagtccctaataggacattttaataatatacagtactaattgtttgttgttacagttaagaattttacttttgggtctaattgttttttctaactaagttttaaagagaagggaaacttaagcaagtacattcattctaaacttgtgtatataatctttaatcttagaagtgcatctgtattttgatttttaggtcagcgtacacaagtagagttagttgtccgtagtccctcaccttatctgcggttttgctttcgtatggttctgaggtcagaaaatattaaatggaaaattccagaaataagcacttcataagtttaaattgcacaccattctgagtattgtgatgaaattcatgccatccacttctgtcctatctggtctcacctgggacatgaatcattcctttgttcagtctatccacactatatacaccacctgccgttagtcactgtgtagccatctcggttatcagctcgactgctgtggtatcacagtgcttatgttcaagtaaccttattttacttaataatggccccaaaacacaagagttgtgatgctggcaattcaagaagctttaaagtgctccctttaagtgaaaaggtgaaagttcttgacttaagaaaggaaaaaaaaaaaaaaaaaaggtatgctgagattgctaagatctacagtaagaacaaatctcccagctgggcactctggtttaggcctgtaatcccagcactttgagaggccaaggcaggaggatcacttgaagataggggtttgagaccagcccggtctacatggtaagactctgtctccaccaaaaaaaaaaaaaaaaaaa

SEQ ID NO: 338 - DNA, 2961 bp, Homo sapiens
gggatccagtgttgataatcagacattgaagtctccagctattattgtaaaactgtttcatgtttgaattctgtcagtttttgcttgagatattttgatggtatgttactaggtgagtaaatgtttatattttttacatcttcttgctgtattgaagtttttcatcaatatttaatgtctttctttttctcttacaacctttttttttaaatttaaagtctattttgtctgatattagtatagccactcctgctttctttgtaattatttgcatggtatatcttttttcatccttccattttcaaactatttgtgtctttgggtcaagtgagtcttttatagatggcatatacttggatcatgtttttcttttcttatccatcctgccaatctttctttttgattggagagtttaattcatttacatttaaatatttattaataatgaataacttacttttgtcatttgctatttgttttctctatgccttatagcttccatgcctcttatttttgacataactgcacttttttgtgtttagttctttttacgtagtacattgtctttatacctttctcagtttcttttgtaattctatatttttttttgttacaatgggaattatcttaaagttacaacactgtaatctaatttataccagtttaacttcaataacacacaaaaactctgcttctttactacctctgtctccatctttttcagttattgatatctctaaatttcatctatatatattatatgacccaaaacataaactattaaatcctttaattgtatttgtatcttaaattatgtagaaagactcaatttgaagctttgaaccaaagttgcaataatactagcttttagacagctcatagtgtccccagattctacaggaccaattttcttaaatttttttctttctgtacttcagaatcagtaattctcattgtcctatcttcaagctcatgggttcttttgcctactcaattccacctttgaatccccatagtaaatttgtaatttcagttattgtaattttcggctccagaattttttggtttcttttgagttttctatatcttcattgatatttcaattttgttcatacattgttttcttgaatatattaacatcttcctttagttctttgaccatttttaaaatagctattttaaaggctttttctaatagatatgccaacaggtcttctacagacacagtctctgttgttctttttttccctttgaattggccatactttcctctatttctttgtatgccttctggctttcggttaagaactagacatttgaatctaattatgttgtaatttggaaataagattttccctgcttcacaactttttctgtttttttgttattgattttattgcttttgatattataaaatattgtagtaccaaaaatcagccagtctctttgctaaagcctagcaaggatcacctttgcttcagttcccgataagctcctcatcttcatctgagaccacctcagcctgggcttcattgtactggacttcattttggtacacagacgttgtccatatcactatcagcattttggtcaaaacaaacaagtttctaggatgctccaaactttctcacatctgtttttcttctgagccctcgaaactgttcctactctgcctgttacccagatccaaagtcactcccacatttttgggtatcttaatatcagcaccccactctaccagtgccaatttactgtattagtctgttctcatgctgctataaagtactgcctgagatggagtaatttataaaggaaagaagtttaattgattcacagtttcatatggctgaggaggcctcaggaaacttacaatcatggcaaaaggggaagcaagcacatccttattcacatgatgacaggaaggagaagtgccgagcaaaagaggggaaagccccttataaaaccataagctcttgtgagaactcactatcaagagaaccgcagcatggagttaactgtccccatgatttaattacctcccactaggtccctcccacgacacatagggggattatagaaacttcaattcaaaatgagatttgggtgggtcacagccaaaccatatggcatatctgcttggagtaagcctgttatttagagagcattgaaaactagccagaaaggtttacttttaacttagttggctgtaagaaattattgaaattttttttcccgtaagaaaataatacgattgaaataaaagtgaaattcagaaatcaaatacagttatgaggtatatgcaatatgcaaactcaaattaaaagtagtctagagatgttcaactttaaaccattgttttggcacattctatatatttaaacttaaagttaatacctcaaggtgggctattaattaataaacagtatatatttattcaagtttgtgtatatattagaatctacagaaactatgtatgttataaaatgaagatgaaaacattctaaaatagaaagaaaaataaaaatgaccatatcctttgccccataaattctacttctatacttttaaccttaaaaataattcagaaaaaagataaacgcatgaagacatttatgtctgcattctttataataacaaaaattggggaaaaaaactccatgtcaagaaagtgggataagaaaaatagtgaagtattatactgccattagaataattatttggaagtctgtagaaacgtggacatgtttgatatggtaagtaaaatgagcacaatacgaaatagtatgcatactatgattgtgactttgtaaaatctttatgcatgtggaaggtaatctgcaaaacaaattcattgtgttagtgtagcgggatatggaatggctttatttatttaaatcttttctttaatattactttgtattttcaataaaaataaatcactgcaaaaaaaaaaaaaaaaaa

SEQ ID NO: 339 - DNA, 3703 bp, Homo sapiens
gggactgaagacatatatgtgttatttctaagcacatttcctatttatgtgataatggagatcgccctttaaccatcacttggacgtgaaggaggattcttcttcctccattagtaaatattccttgacttgataatactgaaaatatgtgaggtgaatgagctttaatcctgtggtttggtttggtttttggttgtttgcagtcttggactgttcacctgcactgtcttgtgcctttgagtatgattaactgccttgacgccttacagtgcattacacaactctacttcttccatttcttgactaatctctcatgctgtttgactgcccattggaatctttaagttagctacttaggaaagactttaggaaggagaatgctaagagaactggcagagaagtcaggagcctgggctctgtccaggccctgcgtaagtcctttcacctcttcctttgactcctttacaaaatgaagttgaactcattcgagctttaaaaagatgacgccaagaggcaagacagagggcagtagatgtgaaagtaacatgaaagagaaaggaacatctgaaaaaaaaaaaaaaggtagaaaaagattttgacaaatagtactaaaaacaaagaaagaatatagaatagagagacccaattatactgataattacaattatcagtattgtaaaaactacagcaaaaaagctaaaaacatattcagcttttattgtccataaaaagtgatcacaccatgtctaactgtaattcgtttgtcaaagacactagaggccaaggactaaattgcggattaagagtttcttccttttatttcctgcatatccagaaacctggggtcatagatactcttccatggtgtgttgtttggcacaacttgcaagtattttggcagatggttagaaaaaaagactttaagaaatatgcaatagtactcaggactctaaatataataaataaagctaagataccagtatcctgccattcattacaatcaacatttattgaacagcagttatatgccaggtagcagggatacctagaacttgcccctcccactagcactccagaagagttcctgctttcccagcctaaagcaacagcaagtcttacatgagctaggcttactgtgatagctgtcctgacggcgagtggcaaacatggcccagtgccttcctcatggatgaacatgactctacactgggactccccggtagacctttttgtgatgatgagaaagtcctgtgttggtgatgttcagtatggtaactagtgactgtatgtgctgttgagaacttgaaatatggctactgtgactgagggacagaacatttaattttatttaactttggttgagtttaattcaaataactacatattactaatggctactgattggacagcagctttctagacccattgttaaaaataattataagcaatgagtacctcttatgagatagaattaataatcccatttattgagggcccatgacagattaagaattatgtttgacatatattatccctaatcctcacaagaatggttcatttgacaaataagataactgaagttctgagagataaattgctttgttatgtcctcgcaaggaattgtgagagctggaatttgaacctaattggtcagactccagagctgggtgatttctagtaatctgccaaatctgtgtatgtactgtccggatgctgtgtcttctgagtacatcttctccttgctttatggattagttagcaatgtctttatcttggtcacataggacagttacagggtccatcttatctcttctgaatatggacgtatcactgctctggaaccattcatttctcttactgaggcctatgtccttcaaaaaatattaagagttgagggtccaacccagcttcttgagtagtaagctaatcacctacaagtatatttccccagtagatgctgagagaagcatcaaagtacatgggtagttctgtggacatcagtggcactcagtaaactcttggcatttgagtgtttaactgtcacagttgaggatatctgtgaactctcccaaggcctgagtcactgaatgagcccagccagtacttgggcgtctgtggctccattctgctttgctgttttctgctttccatggaacatacagtaactctcttgaagggtctgaaagcctcaattacaacgtttcagtgattctgaactgatttttcttaggaaagtatatatgcagatggtacttgcaggatcaccagggggtagtaacgtggaggagtggtaaaggtctactggacaatcaggtggctaccacccaaccactcatggtgatgtgatatgaagccacttttctttattccttcagatttaaggtttccccttcaggaagcaggttacttaacaagtacttgatttcaccataacatgcattatgacattatctttttttcttttctctttttttttttgagacggaatcttgccctgtcgcaggctggagtgcaatggcacgatctcggctcactgcaacctccttctcccaggttcaagcaattctcctgcctcagcctcctgagtagctgggattacaggtgcatgccgccacacctggctaattttttgtatctttggtggagatggggtttcaccatgttggccaggctggtctcgaactcctgacttcgttatccacccacctcaacctcccaaagtgctgggattacacgcatgagcctccgttcctggccgatattttattttcttaaaaggtcattatcagatgccacaagagtatttctataaactatgacccaagtatagcctaatgttaatagcttaaaataggttttatttaccttttttgccctttaaaagcaaggaattattttttaatggaaagaacatagactttgatgatcagttcacatccttgctttaccccttgaaaaatgtgcaacctggaaagacagcttaacattcctgagtcacatttgtccaaataatacaaacaatggcaacaagacttcagcactaatgtctgatgttttttgtatgattaatctgtgccaggttccattctagtttctttacacacattataccatctaattctcacaacaactttgcatagcaggcattgtcatttccactttacaagcaggaatctgaggaccagagttaaaagtaactggtccaagattgcctagttaataaatggtggaatttgcagtcagacccaagctggtttgggccaatacacttgaccttcttatgatacgtcagccttgtgaaatagggcagatactattaataatatccaccttgtgtgatcattatgaaggttagatataatgtatgtggaactcttgccaccaaagtggttccacaagaggccctaaacaaatgagtaatcattattatttaaaaatgtccgtaagtgaaaccgatttgccaagaccagtaaaaatgagagcttcttaaggaaaagagtaggaggcatacctttgtttcattttgtttgttggtttctgtgcttgctttttgttcttttctgttaggcacaggttttatttagaataaattaaatttttttttctttgatgagtgcggaaataatagttggaaacattgaatggaacagctaatgtaccatagtaatacttcttggattactaaaaaaaaaaaaaaaaaaaa

SEQ ID NO: 340 - DNA, 2539 bp, Homo sapiens
tggcagataaactatactgtatatgctgagtacagaatttgtgggaacataatgctgcaaatgaaagctacaaacactctgtaaatagcttagaaaaactagtaatagaaatcaccaaagtaccagctaataacggtgttataagagtacactgttaactgaaaatgaaaaaaaataaatgtattttttgagacggggtctcgctctgctgcccaggctggagtgcaatggtgccatcttggctcactgcaaccttagcatcctgggctcagagatcctcctgcctcagcctcccaaacagctgggactacaggcatgcaccaccatgcctggctaatttttgtattttttgtaaatacgcggttttgccacattgcccaggctagtcttgaactcctggactcaagccatctgcctcattacaggcatgaggcaccatgcacggccaaataaagctcattaatctcccattttcatgggtttgacattgcctatcttcagatttgctactttgaatttagcacattatatacatctctagacttcccaaaaagtatagtctaagatataagtggctaatcagatttgacagttggctttctgaaagttttgttccgacaaacctagaatacttacttcaggctttgcaccattacttgatacacctattccacggcttgtttctttggctgaaggaacagttctgagactagctggcaagtcaatgttggttgttcctagagctttcgctgcattggtttttgctatttctaacagctccattcgatctaaaaaaaaaagagagagattttaaaatactcattaatctggtagttatttcccaagagaactcagaattacacaataaatatgttattttgtggtattaaatatattaagtcacttgttttataataggtaaactaaggttgcccttgaacactagtagctgcgctggtccactttatacttgttttttctcccccttactaaatgcagatagaaagtaccacagtgtttgagagactgtaaaccccaagtgtgcgcgagggttccatatgcatcctggcaccaaacccccgagtgaacagagggacaactgtgtaactttattcactgaaaattctattctccagctcatttcttgctgaaaagaataaaattcttaaattatctcaacaattagttttgttttcttgactaaaggcctgagcgtcctattattttgtctttttgttgtacttaattttctctagctaatagtgatattattttgctttctcttcaaagatgtatttctgaaaaccaggtttttctgctgtagattctttatataattatcacaaccactgaaccaatactgatacactactaaagtgtatttctaccgccacccccggctaatttttgtacttttactagatagtgagctatgttggcctggctggtgtggaacgcctggcctcaagtgacccacccgcctccgcctccgcctccccaagtgctgggattacagaggtgagccgccgcgcccggcctcctaggtcacttaggatactcgacaatccaattttattcagtaataatgtcaactaaaagaaggcgtgttttgatattgttcttcccaatcacgttaacttagaacctttaacttaatcataacatttaaaaggctccacccactaagaacagtcagccaataggaaaaaaagttccctacatcctgagccatttaacttccagttgacctttaaccctaaagagaatgctgtccacttaaatacaggtaatgtcctccctctttcctccaaaaagatttcgggcactaaaggaactaatattgaaactacacagcaacgttggttccctagcctactcatatactgccaccatacattaccacaaatggaaaggtaaatgacccacccacctttttcacttaagcgaaagggggttctgctccgcgacctcgtcctggatctgtccctccatctgctgtgctcctccgggtacactgtgcgaccaaagccgtagtagcgctgtccccgcgcgatcgcgtacgcccttccgcagtacgaccttccccgagagcgcgacctgctacgggaccgggaccggtaccgcgaaggagaccggtagtatctcctggtgaacccgtagcgcctctctcggtaacggcggctgcgggatcgcgaccggctccgcgagtatgaccgcgagtagcgcctgtacttccgctggtggcgccttcgggaacgggacctggacttgctcctccgactcctggacgaaaaccggctcgagacgcgggaatgggaccgagagcttctggaaaaagagcggctcctagaccgcgacgacagccggctggacccgcccgaccgcgaggtcgagggcgaatccttctcctgcggcgagcccggccacatgtcgttcgcgtagttggacatcttcacctgcggctttagcctgcgctttctccggaaaggatcccgcaagcctcaactcaggacttccaaaaaaaaaaaaaaaaaaaaaa

SEQ ID NO: 341 - DNA, 1074 bp, Homo sapiens
ggggatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcagtcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattgaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgtcgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaaaaaaaaaaaaaaaaa

SEQ ID NO: 342 - DNA, 2561 bp, Homo sapiens
gaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaacaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttaaaaaaaaaaaaaaaaa

SEQ ID NO: 343 - DNA, 2278 bp, Homo sapiens
ggggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaaaaaaaaaa

SEQ ID NO: 344 - DNA, 1737 bp, Homo sapiens
gcggacgcgtggggggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggttttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaaaaaaaaa

SEQ ID NO: 345 - DNA, 1249 bp, Homo sapiens
gggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccgggcagagggggacttttcttttattggaagaagtaaacatggctagaaagaaccacgttcagggaatgacgttgtgcccagccttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcggccttgctggcttctccctataaaagtaaagcctttttctgccccagctctgggacacttgcagatcttaaggtctgagacttgctgattttctggttggagtgtttttttgtattgccatagtcccttccccctgaagcaatagcccctccccacctcctgcaatacgcctttccaatctttattggaggtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaaaaaaaaaaaaaaaaa

SEQ ID NO: 346 - DNA, 2351 bp, Homo sapiens
ggtggcctggcacccagccagcagggtaagggcagaggtggctgggcccttcctactggaaagggctccccaaaccgccaccccccaccaccacgggcctgggcagggctggcagcacacaggacagccgggaggggtgccacccaaccacatctccttctcggccacaggctagatggcatcttcctggagctgggcagtgaggagcagaagagactgcctgccttcaaccgcacgctggccctactccggcaagtgctgaagtccgaggacccccgccaccgaggtggggacccgggggatgggtgggacagcagcctctgccccctgccaacagcccgctggcattgcatccacctctggcattacctccccttcttggctcctgtttcttcctccttcgctctgtcccctacactcatctgtgcacctcaaggagcccacataccttgcccaagtgaacatgccaactacaagtcactgtgactgcaggcttgcccgtctgcagctcatgacctggagggtgagaggtagtttcccctatttccacctatttatggtcagaagattgaagcctctgttggagaggagtcgagtcatttttttgcagggccagacagcaagagcagggactagaaccaccagagctggtgagagctgaagtcagaagagacctacgtacctgaaatgaggtcccccgatgacacattgagcacagaataagcactaaaatgggttcactaacccctcacatggcccctctctccacctttgcttctctctgtccctgtgttgccctcagtgatcccactctactatcccttgctttgtcttcatgggtgacacctaggatggggatggccccttccctctctccaccctgctgcttcctagagaccctctcccacccttcacccccagccctggcctggtgctacctcgggatgctgctggagcggaaggacaccttctccaccacccccatgggcgtccatgactgcgggtactcagggaccgaccctctagactgcttcggcaaggtacttgcccccagccacacccaccctctaaactgagaaggagcctggcaccccagcctctccacctagaacccaggcttctctgggtatcaacccccaccgcgtggcccacccaggaagtacacttactccagaccttgctctccatcctctcttcattcaaaacaaaagagaccctccccatacccagtctggccccagcccatttctccagccttgaaatagacccttagactttttcccttgagaccttcattcacagtattccctctgccaggagttccctacctctccacccccagtggcatagtagaaagatgggtttagctggtgtctccttgccagccctgcccataggctgtgtgaccctaaggcaagtcacttacaacaggaagcagtcaatgacaatagtgggggtaagtgttattacccaggtagaaaccctgtactttgtaaggttgggggatgggggttgcctctggcccttcctctcacctgccctaggaagatgggagagcatacactgggaaggaggggtctgactgggctctggaaggctttactggatgtgaccggtgatgtggtcgtgggccaggctctcaggagttgagtgccaataggttgtgccccaaggtgttggggcttcgtgatgtgacaacttactggcaggtggataagggtggatatgggtaaagggcaccatgttgatacggctgtatccaaagatggggttcctgtggttcagcactgtttagccagctctggctaatgaccaagcaagtggtttgtttttgcactcctcccttacctaggccattgagattgccaagaaccaacctcccatcctgaatcgcctggcaaaaatcttctacttcctgggaaagcaggatatggccattggaacctgcaacatggccctggatgtcctacgagatccagagctcaactggcaggcgtactgcacaagggccaagatccacatcagagcctacctgcatgacctcaagcgggccaagatgggtctcgggggcatgcctgacaggaaccacctggcctgtgccaaggctgaccttgaggaagtggtcagggtgtgcccaggcttcaaggcgtacctggacatcggccaggtctactactatatgggcgtggacgcggtgcaggagctgctggcggtggacgaggcggcgctgaaccaggcgctggtgttcctggccaaggcgggcgagtcggagctgggtgccacgctgcccgagctgcagctgctgcgcggcaagtgcctgcgcatcaagggcgaggacgccaacgcggccg

SEQ ID NO: 347 - DNA, 1433 bp, Homo sapiens
taggaagaagcgctcaacacagaacaccctaagtatccctactccctttcaaggactaaatcccttcagagatttcctttgcttcagtccttcaggagcctcccgaagatgctaggagtcgtttaagaaggctggaagatggccgttgggaaggaactgttggtagctggcaatacttcatcccaaggaggcggtggcaatagctccctgggcagcagacatcatggattttcctccctctgggaaccagaggtccctccgtttctggtttgaatcccttagagacaaagaacttcattctctcccatacccgcgtgggactgctggggaggagagggggtggaggggttagacttctacccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaaaaaaaaaaaaaaaaa

SEQ ID NO: 348 - DNA, 2905 bp, Homo sapiens
gcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttcaaaaaaaaaaaaaaaaagggcggccg

SEQ ID NO: 349 - DNA, 1857 bp, Homo sapiens
gggggacatttgaaatattgccgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatatctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcatcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctctcttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaaaaaaaaaaaaaaa

SEQ ID NO: 350 - DNA, 1340 bp, Homo sapiens
gggtacggctgcgagaagacgacagaagggtacggctgcgagaagacgacagaaggggtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaacagtaaacacccttttgaaaccaaaaaaaaaaaaaaaaaa

SEQ ID NO: 351 - DNA, 1565 bp, Homo sapiens
gggcaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccactactgcacgcttgtgagctgtcatggaaacctgatccccaacagcttttgaggttgtttgtttgtttgtttgtttacctgtcttgggctttgttgcttttggcaaaaggtacttctaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagccccaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagaccctttttttttccaattgtgctgagtctcctactagactcgcttcattctagctttctgcttttgcctttaccctaatctttttatttttatgctattgtactttatttttgtaagttgccgagatatctgttttgcaacaagatgggctatatctaaataaagacatgatcaaaggaaaaaaaaaaaaaaaaaaa

SEQ ID NO: 352 - DNA, 3104 bp, Homo sapiens
ggggataagttttttttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagatgcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggccctaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcgagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaaggctaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccaaaaaaaaaaaaaaaaaaaa

SEQ ID NO: 353 - DNA, 2535 bp, Homo sapiens
ggggggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcaagtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaactcttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtaccaaaaaaaaaaaaaaaaaaa

SEQ ID NO: 354 - DNA, 2121 bp, Homo sapiens
aaagatggactttccagtttaaaagatttagagaaactgtaccaacttgggatacaataagagatgaagaagatgctcttgatgaactcttgcagtatttgggtgttactagtcctgaatgcttacagagaactggaatctcacttaatattcctgctccacaacctgtgtgcatttctgaaaaacaagaaagtgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaagtaatatttcacatgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgagaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctggtgccgatcattaaatatcagttctgtttatctgaaggctcctacccagagattctacccagtgaaactcccacagcagcgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcatggacatagggttaaccctttcaggccttcatgtctgccataacatgcatgtttcttcctgtacatttatttgagaaaacactggatttaaataattttaaataatttgtagcttaatattaaagatttaagttatttattgtttcatttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgctccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaaaaaaaaaaaaaaa

SEQ ID NO: 355 - DNA, 1199 bp, Homo sapiens
cattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaaggaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtttaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggaccaaaaaaaaaaaaaaaaaaa

SEQ ID NO: 356 - DNA, 3489 bp, Homo sapiens
gatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaaaaaaaaaaa

SEQ ID NO: 357 - DNA, 2028 bp, Homo sapiens
tcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagggatttgtgtcctttcttatgaaccttcctgattttttaacttagatttctcactaagtttcctgagttattagtaagattgctccctaaatgtaaccagggattttcccattatgttcccttttataccatttaggtgtgagttccttagcttctgcctataggaacataagtaatgaaaggtcatctaggtgtgtgttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccgtctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcaaaaaaaaaaaaaaaaa

SEQ ID NO: 358 - DNA, 3030 bp, Homo sapiens
ggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaaacagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaaaaaaaaaaaaaaa

SEQ ID NO: 359 - DNA, 524 bp, Homo sapiens
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacaccaaaaaaaaaaaaaaaaa

SEQ ID NO: 360 - DNA, 1936 bp, Homo sapiens
cggacgcgtggcggacgcgtggggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacaaaaaaaaaaaaaaaaa

SEQ ID NO: 361 - DNA, 490 bp, Homo sapiens
tggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaaaaaaaaaaaaaaaaaaaaaaaaaaaaaaaaaagaaaaaaaaaaaaaaaaa

SEQ ID NO: 362 - DNA, 4576 bp, Homo sapiens
aagcactattatcatatcagggatctccaaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacaaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaacctgtatcaaaaccaaaattataggatttttttcttttttagtaaaaacctatataaaaaccaaaattataggattttttcttttttagtaaaaacctatatgaaaaccaaaattataggttttttttcttttttagtaaaaacctgtataaaaaccaaaattataggattttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgctagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaacaacaaaaagtagccatctccttgttgcagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacactaaaaaaaaaaaaaaaaa

SEQ ID NO: 363 - DNA, 1123 bp, Homo sapiens
cacttagcaaagacagcagatcctggtgccagggcacagggctcacctggatgtggggaggagtggctctggcacctgccaatactttgggtcctacaggccctgcttgaggtctttggcctctttggtctttggtctttttctcctggaacagaagttgaaatggggaggagacctgggcagtgctcttggaaattaacccttcacttctctgcccctgtgtttcagttcaaatcagccttctcatctgcagaaaccacagaattgagtggcaaatgtgtggtggctttggcaacaggtgaagtttgggggcagctggtaataagaaagggcatggaggatgtgtagtgcggtagcatccagtgcccagatctggctcgggagttggttgaggaacatgtcattcttttctctgctttttgaggcccaaggggtcagcattcccagtttgaggtctgagagccttaggagcaggctcctgggaagtgtggaaaaagtccaaggcccaagagaaagagctctccagggatcctgagctccagggctctcagcagtgccctgtccaactgggcccaaaccttgtcactctgcatactcccctgcctgccatctccacctgtctgtgtgcccgcagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaaaaaaaaaaaa

SEQ ID NO: 364 - DNA, 1738 bp, Homo sapiens
tgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggag

SEQ ID NO: 365 - DNA, 1261 bp, Homo sapiens
gcacgaggagtaaagagaaagaaaagaactgtttttattttttgtctacctttattgtaaggagagagtgaggataccatgccacacatgcagggtcctgagcagagggctgcaccctgcttagttctaaagacacctagactttatcctgaaagccactgagaggcccatattttgaaacactcagcctctcagaagaggatagaatgggttgccagtgtaatagggagagaaatcgaacatagctgactccatgttgcttctgactcctcaagctaactgcttttaggcacttctgcacacgggccaagttaatcatggaaagaacttagattacagtttaactggaaagcaaggatgataagcgttcctttccaaaactaacctctgaggagataagaagggcatgcacacaagtaacaatgttatattgaagacttgtaggagcgctgtgacctgagcaaggacaaagttttgcaatctccttgggcccctgctgatgcccaagtgtctgtggtcaccagccacccccctcacctcagtctcctccttgttccccttcagtgtaccccttcaatgtacaaagaagcttgagattcatgcctttaaagatggttcgttaggacatgggtccagtatcttcctgacttgctggctctccaaataaagatgcttttcttgctctaactttttgtctcgtgaatcattggctgttatgcagtgagcctcaggaactttggactccacagcaccaggacaactctcaggactcccagtctctattgggtgcaggaatcactggggagtctggctgaagtgcagactctgattgaggaggcctgggacacgaggcctgagattctgcatctccagtaagcaccaaggggatgttgatgctgctgatccagggaccacaccttggagagcaatgctgagaagctggtggaagagcccaggctcatgaagatctgaacatggtccatagcagggaggttggggaaatgagataaaaatgttaaaaatggcagttaccttcctggagaagaaatggcttttccattccttattaggctcatgtctttggaactagcccccactggtctccttcctgttatatacctgcagttaccatgttcttgttaaggaagaatggcaaatgcaaaaaaaaaaaaaaaaaaagaggaagttgatcatgtttggttgcttttggtcatcacaataaataaataaaatctgaaatttcaaaaaaaaaaaaaaaaaa

SEQ ID NO: 366 - DNA, 827 bp, Homo sapiens
tcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagttgcataaagtgccctcacactgctgtgcagccattaccaccattcatctccagaatttgttctcagtcccaaactgaaactataccattcaaacaacagcgctccccatttc

SEQ ID NO: 367 - DNA, 1866 bp, Homo sapiens
attcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaaaaaaaaaaaaaaaaaaaaaaaaaaaaaaaaaaaaaaaaaaaaaaaaaaaaaaaaa

SEQ ID NO: 368 - DNA, 2589 bp, Homo sapiens
ggcagacagcagatgctctcagatttggtggtgagttttggccttggcatggttggcatggagtcagcacaggaagccgggaggtatgaaggggcatccacctgggtgaaactgtcttgccaagccaaagccccgaggcctgccctgaagcagctgtagtggaggagaggcctgggattccttagagtcacctttttacgaatgtaccgccactctgttagctcacaaggaaaataaggaaaagccaggcctcccacctcttgactcttgtgagagtgaagacaacatggggcatttagaaaatatatttttagtgtatgataatgtgggctggcccacacagcaatgagcccaaagaccccctcgctttgggaattattcatggccctgctcatcacagcctctgatatgcatgactgtaacctaggctgagccaagaatggagctcatgccagaaatggtcctaagcatgcacatggccccctggaatatcaaaatcctggggagaaagaaatcatctttgccttgggcagtgaagctggaatggcacatatctatctgttgccacatctcctgcctagtggagaagccttggaaggcaacagacactgagcaagcagcagggaggagaatgtcctggaagggcaggactctacccaagtccctaacatccccagactcttctcttccataaactctctaattactctgctgtttaaatcctggttttggtcaagccagtcaggttgcataaagaatatgaatacagtatgcatcaaagttgcttcccagaacaggaagcaaaacaaacaaacaaacaaacaaaatactgatatcagtacccagggtgcccaattaggtcacacccagtggctgcattgcagcccctgagctcctgctgcaccgtgtgtcctgctgcccgagtgggccccaccctgggttctgaagatgcccttcttaatggagagctcccgatggagggctccaggactgatgctctccctaaggaagggaggcctcagatttggagagggacaccaacaggaccagaggaggactgaggggcactggcaccaataagtggaagggaacagcgtggtaacaaaaaagagccatgccacttgcatgctggagggagtctttttgtgtcagcctaaagcttaggctggtgtccatgtggaacatgacatctttccagtatccctgatccaggaaactgcagtgagacccaggtgacccagctctgtgtcatttggagcccattaaaaagtgaggcagccacatggcggggacattgaccccactccagaccacactcccatctccatacataggatagaaactgttcatcaggaaggaaaaccaaacagaaatttgtggtctaggggaggggtctgcattcagcatggccatgctgggctggagtggctgtggggtgtccagatagatgggcatgtagactagtgctttctcaacctttaatgcatgcacaaatcatcgagatcttgttaaaatgtagatcctgggtgggcacggtggctcacgcctgtaatcccagcactttgggaggctgaggcgggcggatcatgaggtcaggagatcgagaccatcctggctaacacggtgaaaccctgtctctactaaaaatacaaaaaattagccaggcatggtggtgggtgcctgtagtcccagctactcgggaggctgaggcaggagaatggcatgaacccgggaggcggagcttgcagtgagccgagatcgtgctgctgcactccagcctgggcaatagagtgagattccgtctcaaaaaaaaaaaaaaaaaatgtagatcctggctcaggaggtctgggataggacctgggattctgagtttctaacaagctcccagggatgtccatgcttctggtccctgaaccacactttgagtgacaaggatgtaaactgttggaaacatggatctggtgctcattgcgggaaagggggtgtcctcagggcataggtcacagccaaagccctgacagcgggcaagagtcccagggagaggctgcctgcacattgaggaggggaagggctgggcctgagcagtggggagcatccatgctggcaggtatgcagcaggcaaggagatccaggtggagatcagaggacagtgacagtcacagcagcaggggagagccaggagaaagctgctcctaggggtgtctcaaaggaagaagggctctgcagtgtgaactctgcagagggcagggagaatagaggttaagcctttgctcattctgaattaattgattactgctttttaaaagtgctttctttctctgggaaaaaaaacattccccagtgcctaaggctaacagacgtgggcgctgagctgtgtctggtctgctgagtgtattttccacagagcaatcctcatcttctcagggggtggggatttggacaagactcttcctgaacacgcagcgtggtggggaagggtggccatggaggttttctgttccttctgttgtcactggtgaaagacgacttggtgcccaatttctaataaacacaatgctattagcgtcactccaaaaaaaaaaaaaaaaa

SEQ ID NO: 369 - DNA, 2188 bp, Homo sapiens
gctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagataacatgcccactttgctgtttcttcagaaatgttaaaatgtttaccagagaactaataaatgttgttatggctggaaataaaaaaaaaaaaaaaaa

SEQ ID NO: 370 - DNA, 2749 bp, Homo sapiens
gcacaaacaagctggagcagcccagaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgcttttttttaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaaaaaaaaaaaaaaaaaaaaaaaaaaaaaaaaaaaaaaaaaaaaaaaaaa

SEQ ID NO: 371 - DNA, 2605 bp, Homo sapiens
gcatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggacgggtcaaaggactcttatgtcactgcagtgtcccattctaggattgtctgaaggccagagtaggggttggggggagtgtggacaaaccccgcaaatcagagtggggaaggtgagtggtggagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgtgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcgcaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttaaaaaaaaaa

SEQ ID NO: 372 - DNA, 1464 bp, Homo sapiens
gaaggcgctgcgggcactccggatcgcattcacaaagtcgtcgtagtccgcaggagtcagtaaacaaatgaagagctagaggaagggtcctctgaagagccactggcacaactgcagtcaggtcaaatgatttacctgtaatccaggaaacgtgggaagaataagtacgtgagagccagttgggagaaacaaagttgtgcaggccaagggcataaagcccaatctcgaaggcgcaaaggtgcaggttgcggtgaggaccctggtggccccctgaggaagatggatgtgtgaaaatggaagtgctgctgttgccccctgccttgatcagcactgtcttcgccagctcgaagtagaagtgtgcagctgcctctgatggctgattggtcttcgcccgggctcctccactggcactggcccggcgacttccactggaggatgaggagcccagggagtccgaagaagagctgctaatgctgtcactgtcctgacctcgaccccaggaggtgggggcccagccccctcgaagtggtctccggcttaaggtgggggaactatccgatgttgtttcaggggcactgctgtcaatgctggccatgcctaacccccaagagaagtcagtctcagaagtcaggagtcccagatgttaagactccaaccttcaggattatccttccctctatgctagcccacaggctatcctacctgtgtgcttcttcttaggccgtcctggggacccccatccccgtccattatagcctccacgactgccaagtgccaagcggctaggaaccttcccttctggccttggggtcaaagctgcctcagatggaagaccctcacagggggaatgtggggaactctctaggtgaggaaaacaggacgctgggatgagcccaggaaaggggacctcaacataggtccacaccattcatcccccctgcccagtgcccccacctcaccaggcacattcttctctgtgaagccctcagtggggcctggcccagcccctgccacactccctggttgagcaggccctgcagagcctgaggtcagtggttgcagggcccctggggcagatgggcccccgtgctttgaaggagacctctggctggctgtggttgggcggctagatgagtagaaagaactcagcgtctgtggcttatgtgtctggctctctcggtccaagagtttgtctaagatctggaagacagaagcagtgacctccagagaagcagtgacaggatgccctttagctcctgacttctattaccttcctttctccttgaaacagccaattgctacatcctcagggagccttccccacttacaaccacaggatgacctcctggtttacatgtctttttgtaacttatttaaccccaacatatcttggtatcctccattaacaccacagggcagaatatactgatagtcaataaatactgaaataagtgaaaaaaaaaa

SEQ ID NO: 373 - DNA, 1730 bp, Homo sapiens
gagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatatcttcattttaaaatattttgctgcgttttcttcaagggcggcttgtgacaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcatggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagaaaaaaaaaaaa

SEQ ID NO: 374 - DNA, 1887 bp, Homo sapiens
ggagtttcggacacacagactggaattgaactaacgggcaccccaggaagactgtggggcgagacgaggaggatggggggaccagccgtcgccccactctcctgatcatcatcacagcctcgttggggtgtaaacgacccccagtaagctggtgcatgttcaatagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagccgtgcatctgcagctggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacggtgaggaggcgtcgggctggctggggcaggaggtggctccaggagtgcctggtgcttccctgtctcttgggagcatgtatggagctgggccttttcttccattgctttctatctctctcgggcatatttggttagggggtcaggggcccagtgtcttcctcatgacccaggaggcttagggcctgtgggatggttgagtctgatgaaggtgggacagggccagcgccactctcttcct

SEQ ID NO: 375 - DNA, 2779 bp, Homo sapiens
gcctggccaaagggatatttggtttggccatctctggatgcctgattgccaagctcaggaccaggcaatgtgactttgcatcagcaacaaccagcatcccttgaccaggcctgggccagagtattggtctcctctcagcccctgatcctgtgaagtaaggatgtgggggaagacctggcaaggacacagatgaaacacaaacaatagtaattctcaggccatcatcagtggagccatgttaatgtaatctgatggcttctccagggtccacaggaagtgaagaatctgtttcccagcagtggactcaaaacccatctgggctcctaaccttcctgtaaacccctttagtggcttcattagagcaggcgttcagctcactgttctattcatctcaaggaataatgggcttagagcagtttctgtcctgctggttaacttgtttggcctattccattctggattttgtcaagcagtagacaagcaattagacaagaacttggaggcaccatttgtatccactttttagacttaatagaaacattgaagatgaacataatctaccaacgaaagacgtgattcaattcaacactcccttcccatgacccaggctgggcaaggaggccacgtgatgtggagggcacattccttgcctgcacaaactcaccatctgtgcacgcagtggccttccctaaaatcagggaattgttttaagtcttatcaagcagccaagggatgaaagagaaggtgggttttcatcaagactggaaggtggggacagggatgagcatggagctggccgtgggcctggggtaccaagagactccttgagagaccaggcaaagcaagtgattgggacagaggttatctgtcccaggttatctgggcatagatgcaggtgagcccatggccctcccagtacctcctgtctctggcctgttttagaaggttctctcctccccaaggagacacaacaactcctagggccactgaagatataactattgcccaggtttctggtctctaggctggggaagtcctctgggtaggaatcagcaagaagatcctaaaacaaaagctcatccatttgcgttccatgatgctgggatttacacttgaggcttagctttgctcctgccaacttcttcagagctgacacaggatgaaggcaatgccatcctcaaacactgcaggcatcacagctaacaattgtgaagtcgtcttaactcaccataaaaaggaatccactcccaggcagccctacttctttgctttgcccagcattttactgattcatacattatctcacttgtgccaacactcaagaagcaggctacactgacactggtattcctgcctccatattttctttaaaagacaaatcaaagcagatatattaagtgactgttcaagagcacacttggcccaagtggcagagcttggactggatgcatgttttccagctcctcatccagggctctgaccagtttaacctgatgcagtcacgtggaggagcagtgcaggcacagtatgtcccataggcccagtgagatgcattcttggttggctggccttccacttggctacacagggatgtacaaggcgatcccatcttgataagaccaccacctcagagtatggagctcagagagggcaggcatgaagtttccttggctggtgcacctagaattggctgaactcatgagaagttgatatagaacagtgcttgccacagagcggggactcggtaagcacttaacgaatgaatgaattctaagtcaatccaagagtctgatgatttcttgaaaagggtgttagctaaaggatcttaggcatgactgtagaatttgtagttgcaatagaacagagaaagaggaagctttctgtctccttaacactgagctgtcatgttttaaagcttgctcacatcttggcacatttaagagacagtcaccccaggactcaaaaatagggaagtaacagtaacgcaggggaaacgttttctgtttggaggagcaaaggctgagaacactgtgaaaacattttgcgcgcacaatagtaacctgggtaaatgcagcgtgaagggattttagtcacacgtggtctttcttacaaggaaggtggtgggggtgcagatgaggttgctagagaatgttagaggatccctctctggattggagatagggaaagaaagttgcacggctgctgaggccccttctaggtggcaaggctgtgctccctggttctgatgatgtgcctgggtggacatggcccctgtgagtttgtacagtcttgcagcaggatctagaggggggatttccagccagggctgctagacggaggcctactcttccatctttcctgatggcaggatggcctggccagggcctggaagacagagacctcctgcctccgcctcagtaagacgacaaggaaaggcaaatgcccaagggaaagaaaaggaaggctcttctccccagagttccccatgcagacatgagtgcgtgctcagttcagaatcacttctgagaactcatccctaatgctgcagatttgggctggaacagattcacactgtctggtttcaccgaggacatgaaactccaccttgcggggataaagagagaaaaacaaattcatcaaatggaagacacattgaaagtgtttttccttaatgcttatcctgtttttaaaccattatttccaagttgacaccttttttaaggaaaaataaatattttgcggcattaaagctatataaaaaaaaaaaaaaaaaaaaaaa

SEQ ID NO: 376 - DNA, 1253 bp, Homo sapiens
gggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacgtagcacaaaggacgtgccatggtgctttccccaaaagttgtgttgcttttatcagttttctaacttaataaaaagagttgagaaaaaaaaaaaaaaaaaaaa

SEQ ID NO: 377 - DNA, 1597 bp, Homo sapiens
tgaaccccagctctctcacttcggtcccacccttcccaactccccacgcccaagtctttcagtggaacccaagactgtaagaacgtaggccttgtgagagtgaaggaaggatgctcgaacttgcccaggactcaggcttcagcttcacaatcccgaggaaaggaatgacatttccaaactgtcacctttgtagcgctgggtcaaagtctaaagaggacaaataaatagagacttctgtggcctcgttgtgcctattgaacaggagagctgcatgtcacaatcaatgagacctgcacagcttgtgaatcatcactgagactagttgtgtttttaatacctttaaaatgaagccacagcatctattctggaaatgtggcgtaggcttaaaaaccttgctccaaagaggatatcgtttcagccagcatgcagtgaatatctgtggctacacaaaaaaacaaactgtcccgaatgctggaggaggaaatatgacattgtgatgccaggcagttttctgtgacactcaggaatctcttcaatagagatgtacagtgacacttagagccccagaacacaaggtctgtcactagtaatttacataagataaggataaattattgactgggatacatcttactcatccccgacatctgcttggctgtggggttggtcatgtagataaatatccttcccagaaaggatatttggccttcaaaaaagtctctgggctcagagtctggtcccttggggttacatggaatgaaacccagcactttattgctttgactgcctactcttgtcccttcactgcaaagccatcatgctattaaataagcctaacaaacagtaggtgaagcagaaaagaccgatctctttttcctcttggctcttcttccctcctccccctttaggcacagagtaccaagacattgagactgagaaaacctgccccgaatcacattcaccttcagaagactcctttgtgagaagctgagggcctggccctcttcctcttcctggagagaacagcccaccaccacccacagacctcgcgggcctcacttagcgcgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcatttattttccaaatgagcagtttagaaatatgtgatgtaaagtacatactgtacgtttgctgaaaattatattaaaagcactattttaattcttaaaaaaaaaaaaaaaaaaaaaaaaaaaaaaaaa

SEQ ID NO: 378 - DNA, 1186 bp, Homo sapiens
tttgcagtcacctcactaaagaatattcatttatttataattattgctaagtaaacttctcttttaaacaggaacataaaaacacagtagggctttgcacaagtggaatctctaaacagttggtttgtatacatgtcaaaataagttagaatggaatttgtccaggagtttccaagtcacccgagaggctgtgcacctcttttgagaaggttagggaggggtacagacaggagccttgccaagaccaccccccagctcaaactgtgagttgtgctgtttcctcctcctagctttgcccaggtccaaggcacagggcagggggcgttcaagtatcgaacctcacagagggccagtgctgacggcggggctgggggagggaaaggagagccccaccctgggggccagaccttctcccttcagtttccaagaccaaggccactgcactggcaggagggaggaggaggaggagaggtacagggttctttttggtaccaggggagaaagacgtgggaagaggtagttgcaggggatgatgccttctgctcagcaggagaaaatgtcttatacagtgacggggtcactgccacctgagggtcatcatggcgggcacctgggaggtcgtggggcttcggggtctggaagccatacttgggccaccttgtccacccctcagtcctgatcacagtcaccctgaggcctggcttggtccttcacttaaggatccagccttgggggtggctgcgctgcagattggttcctcccaccgcaggcacttgtgaagagtgtgactgattgacacttttttgccttggttgctgggaagctcagatctcccctctgcatgtcccttgcttaggacctcccatggtgtacttggagttgggacctcacctggctctcccttatctttccggctgccattttttcccctttctaactttctttcccatacacttatttgaaatattatctcacggtaacgaaataaagtgtctgtcacctcctgctgtgttgtcatcttgcatgagctatctaagttctctgttcttcagtttctgcatctgtaaaacgatgacaatgacagagccaacctcgctttgaggatcacatgagttaataaaggcctggcacacagttagcactcaataaatgttagttatgatttttaaaaaaaaaaaaaaaaaaa

SEQ ID NO: 379 - DNA, 1227 bp, Homo sapiens
tgagccgagatcacatcactgcactccagcctggcaactgagaaagactctgtctcaaaaggaaaaaaaaaaaaaaaaaaaaaaaagaaaatgataagtctttattatgggacattaagaaaaacctaaatatcatgttcaaagtgattttggggaaacttgataaactaatgctaaaataaaggaacagtggtctcagaagacccaagacatccctggaaaagaacttttcctctagatatggaaacttgtaaagccatcttaattcctataggtttattttgtcaatgcagaatacaaaagttgaacagaacagagagcccagaaacagaccccacatgtgtatgaaaacatgtatatggaagatgacagatagcattactgatttatgccccatgcaaatctatttcagattgattaaagacttagggaaaccctatggtagaagaaatataggcagataactttatgactgcagggagggaactatttctaaaatcaagaatttctatttattaaaagttagtgaaagaataatccccaacttggaaaagacttttaccatgtatataactgacaaaggattagcatgagatatataaagaattaatatgaatcaataagagaatgatcccaccctgtccttggggcccgtggaacactgtgctagcaggctgaacaattttgcgggaatatgggaatttttctttggacgcagtcatctcattcctatgaatgtatccaaatggagcctccccctagaaagagagggggtatttgattaaagatgcatattgcagcagtgcagcaaaagtactgaagctttcatagtgtccactagtagcaggtaacaagtcctgcttggatactactctaagtacaggacacccactcaatggaataatatggagtcatcttataattatgaagacttgtcatgacatggcatcatattaagcagagcacaactcaaaattgtatcagtgttgtataaaaattatgaatcggcagaaatgtggaaaaaggaaaacttgtaatttgttcaaagagagtcttgttttttgtttttttttttggactgtcttggtacagttatgatttgtgaagtaaataagaaatacaactcagttgaaaaatggcagaagtcagataattcaaaagtaatattaataaaaatttctcagaagggaaaacactgtggctaaaagtaaaaaaaaaaaaaaaaaa

SEQ ID NO: 380 - DNA, 1882 bp, Homo sapiens
gtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcatattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgatgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatctttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaaaaaaaaaaaaaaaaaaaaaaaaa

SEQ ID NO: 381 - DNA, 1326 bp, Homo sapiens
cacaggcccagagccactcctgcctacaggttctgagggctcaggggacctcctgggccctcaggctctttagctgagaataagggccctgagggaactacctgcttctcacatccccgggtctctgaccatctgctgtgtgccccgaccccccctaccctgctcctccaccaagcctgatgccaagggctataaaccactggcccaacagaagcttggttcccagagaactggtccctgcctgggacatgctccttgctacagccccttgtgggagctcagagggcatggctgctccccctacggtccctcgcccagtggttctgtctctttatggcaggaagcaatgaggctccccaagaacacacctgaggaaaaggacaggtgagcctggagggccggccgcaccgtgggcctctgtgtctggggagttggtggccaggatcccgagtacctgggtgctgtgacggggcgtggttggcctgggcgtgctgggtgtttgggaatgacttcccatcgcccgcttctgcagcctgctcagccctgttggggtgcagtgtgtccactgcctgcctgtgtgtgccgctgtgctcaggctctcctcttgctcctttcaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtaggggggcccgggggaccccaggcctcctgccgcaaagcaggaagcagctgttggggctgagttgctggagagcacggtggttggctgggctgagccaggtagggagacctcacttcacgggcagttcccggggctttggcctcctccaacagggccggggtgtccgctgccttctaagatctcgctcacggcggcaccacagacggagacccaaatgtgtctgcagagcccaccctgaccactgtataagtgtatactcccccaagaccccttgtatcacccccactgtcgtgttctagaaaacacctatgtcagcccaggcacaatggttctcgcctgtggtcccagcactttgggaggctgaggcgggaggatcacttgaatagaggaggtcgagaccagcctgggcaacatagtgggaccctggctgtacaatagatacatatgagccaggcacggtggtgcctgtggtcccagctccctgcccagccagcctcctgtctccagagaagttctccattaaaaaataatttagcaaaaaaaaaaaaaaaaaaaaaaaaaaaaaaa

SEQ ID NO: 382 - DNA, 1341 bp, Homo sapiens
acgcgtccgaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctaaaaaaaaaaaaaaaaa

SEQ ID NO: 383 - DNA, 1675 bp, Homo sapiens
ctgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaaaaaaaaaaaaaaaaaaaaaaaaaaaag

SEQ ID NO: 384 - DNA, 2940 bp, Homo sapiens
tgcagaagctctttaatttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagcgtcattcttctgcatataggtagccagtttttccaacactatttattgaataggatgtcctttccttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgtgttgtatctgtagattgctttcttccaacccattagctgggatgtttttccatttttttgtgtcatctatgatttctttcatcagtgttttatagttctctctgtagagctctttcacctccttggctggatacattctttggtattttattttgtgtatgggggactattgtaactgagatcaccacgttcctgatatggttctcagcctgaacctgaacattgttggtgcatagaaatgctactgatttttaggccaggcacagtggctcacgcctgtaatcccagcactttgggaggccgaggtgggcagatcacctgaggtcaggagtttgagaccagcctgaccaacatggtgaaaccccgtctcaattaaaaatacaaaaattagccaggtgtggtaacacctgcctgtaatcccagctacttgggaggctgaggcaggagaattgcttgaacctgggaggcggaggttgcagtgagctgcgatcacaccactgcactccagcctgggtgatagtgagactccgtctcaaataaaaagaaatgctactgatttttgtacactgattttgtatcttgagtgtagaaagtcaaaagttttttttttgttaaggagtaaattatgtgttagaaataatagttttttctaaagactaactttttttaagccttttcgctttgtgctaataactttttgttaagccctatcatatgtagctgttagatataagggaatgagtacattctatgtccttgtactttaaccaagatatttgtgctggacgtgctcacaggcatgtcccagcttgcagcccatgccccttccttatttggaaatgttattacttttctaagtcctttcataagcaacttcctcttttcctttgtctttccactgcttttacctatttagaaaagttttaagttattagccagtcgggttttagtttagactgtgaggtttggctccagccaatggagacaggacacggtagcagggacaagctgcgtaaggaataaaaattgcttctctccattattcaggtgtgctctcgccattgttccatctgcgaggagcaccctttctgcagaaagtaaaattggcttgctaaaaaaactttttgtctaaatgctgatttttccttgcagtaccgaggaacaagcattctgtttctaaacaagcattttacttataacattgagactttactgaagttgtttatcaagtctaggagtcttttggaggaatcttcagggttttctaggtatagaatcatatcatggatgaacaaagataatttgacttcctctttttttttttttcatttggatcccttttatttctttctcttgcctaattgctctgactaggacttccagtactctattgaataggaggggtgagagtggacatccttgtcttgttccagtttttagggggattgcttccaatttttgcctgttcaatatcatgttgccggctgagctctttacctactgtgtgacttgggagagctgctaaaccagctggagcctcagtttccccccatgtaaaatgggtacagcaaggaatatctgccttgcagggtcaaagtgaggattaagtgagatagcatgggtaaagcccctagcacacaacaggggggctcctcggccccagaggatgtcaggaacatgtcagtgtcccagagccatcaggaacatgtcagtgtcccagagccatcaggaacatgtcagagcatgtggggacatgtcagaaagtgtctcagagcatgccaggcagcccagcattctagggcacagatcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctgcctcccccctccttggtcctcagggagtgctgaggcttctagggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaagagttttagattggtttcatgttgaagtgataatattctggatatattgggtaaaataaaattatattattcaccggcaaaaaaaaaaaaaaaaa

SEQ ID NO: 385 - DNA, 2535 bp, Homo sapiens
accaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctaaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaaaaaaaaaaaaaaa

SEQ ID NO: 386 - DNA, 3250 bp, Homo sapiens
gggggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggcctcgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccacaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgcctccacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtggcccgtaaaaaaaaaaaaaaaaaaaa

SEQ ID NO: 387 - DNA, 5084 bp, Homo sapiens
gagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataaaaaaaaaaaaaaaaaaaaaaaaaaaaaaaaaaaaaaaaaaaaaaaaaaaaaaaaaaaaaaaaaaa

SEQ ID NO: 388 - DNA, 920 bp, Homo sapiens
gggagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtcagatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttatgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaat

SEQ ID NO: 389 - DNA, 1093 bp, Homo sapiens
cgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaacttaaaaaaaaaaaaaaaaaaaaaaaaaaaaaaaagaaaaaaaaaaaaaaaaagg

SEQ ID NO: 390 - DNA, 3397 bp, Homo sapiens
atcacatctgtttatctgtgctctcccaagacagcattgatagttagaattctaaattgggatttttttaacccttttttcaaaacttagccccatctgttaatactgtatttataaaacagagcacataatatgataaaggaggttaatgattgaataatgaagctttgcaagaaactaaaaagcattatgttttagttacttttattcatccaaagaacaggaaaaattatcttaaatattggcatgttgcaattaaacatttagttcatcagtgtgccctgtataaagtacttgccatactctattatttcaccatgtaattactcagtttgcaagcatctaacccttgcacatcaataactaatgtcacctctgtcctgtggccttgggagccttaattgtaaaaagtagacttctggagaagctgaatacttgggagtagcagaagaaaaaaatcaagaaaattggaatatattactcattcaacacatatttattgaatacctactgtattcctggattcattcttggtattacatcagtgaagagtaacagacaaaaatacctgcccttgacaaagactggggcagattctccagcactactgtcctgagccatagagaaatagagcgtgactatacacacttaacacatgcacggaagcataaaaaacattttcctacatcatctgaatttgttcacatccttttttcttttaaaaaataataacatgcagttatagccagttaacaaatctaccttaatttcctaggaactgtctttgaaaaaatataaatacttccagataggtttatggattttcagttttttataccacttgaaacccttcagtcagattgcttttctcctaacaactaactggtatcacttgcactaagagtagaagtttttattttaaggaggaaaggtgatgttgaagtttgtaccatttacttgggtcacagacagcctggctctaatgcctcaaagaaaagcataaaatagaatgaaggagagacactgaatgaaggcagggtgctaaaaacaattaatgtccatgcagaaacatctaatgctttgccttagaaaagggaggtgattcttcttttcatcctgtttttctgtcattctcctgactccttgttttgagggtccacagttcagacttttaccactcattctgaggatccaccgtttctgtggtttccaagggaacacaggctctgagttctaagcagctaagcttcctgaacttttggagtgtaacctgtttataaataattaaataacagcttcagggcattcatgtgctcattgtaaactagtctaatctgatcataaaacagagtgcctcttaagcaactctttgttagcctaattgtatgcatacacttaaaaattataattgtgtctatgcataaattcagttctctaattcaacaaaacccataccgttgccctaaggatgcgaggtatcactctgctggaaatttagctctactctacatttaaaatacaagttttcacattaaataatttcttattccccaaaagattaatttctgtctctttctagtccctcactgaatttaaattctaactagttattgcactagggcagaggttgagatatcactgatagttcacactggatttgttcaacctgttgttttgcgtccatgaaaatagtttttggtggtaatgttgtgtaatgatgtgtagaaattttattagaaatatttcccccttctttcctttattcttcaagtattttagtatgtatgacaaacaatataaattttgtagctatgtttttttatttcagtgtttagtggctaaattatcagtaagttataattttattaataagtttcactgtaaaatggaccatacaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaaaaaaaaaaaa

SEQ ID NO: 391 - DNA, 3033 bp, Homo sapiens
cacgtgggtgcctctgacccggacgcgggtcccgggtggggcggcctcacctcccggccccgcctggtcacgccgcgctccgcccccaggggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggtacgcgggtggggggtcggggctgcggcggggcggctagtcctggggacttcctccgctgcgtttctttggtcgtccctcagtttcctcttctgtaaaatggggataatgatcatagtgtccgcttcagggtggtttatgaggcttaaagggaagaagctcaggcaaagtggattctcaacggtatgaagattattttccgagtaacctggcgaggttactcctacaccgggaggagcaccgtcgggtcgcgattccaccttgggtcccgggctgctcactattggggcctcatcgtcccctgtcccgcttgttgtgtgactttgcgcgggttacttcccctctctgggctctgcgcgtctggcggctgtagccaagcccaggggtggggatcagagaagcgcgggggttgggggactgtccctccatgcccaatgccctccccgtgccggtaggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacactagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctgcagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacaaaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatattacacttaaaaaaaaaaaaaaaaaaaaaaaaaaaaaaag

SEQ ID NO: 392 - DNA, 3513 bp, Homo sapiens
ccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcctagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 393 - DNA, 4735 bp, Homo sapiens
cggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaaaaaaaaaaaaaa

SEQ ID NO: 394 - DNA, 3164 bp, Homo sapiens
gcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacgtggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaaaaaaaaaaaaaaaa

SEQ ID NO: 395 - DNA, 2417 bp, Homo sapiens
ggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaatttttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgatgagtttaaaaaataaaatatatgaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaa

SEQ ID NO: 396 - DNA, 1343 bp, Homo sapiens
agaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaaaaaaaa

SEQ ID NO: 397 - DNA, 2064 bp, Homo sapiens
tgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccaaaaaaaaaaaaaaaaa

SEQ ID NO: 398 - DNA, 2480 bp, Homo sapiens
ggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggcccggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccaccacctgacgtactgccccggggccctaccatgccggacgaggacttcttcagcctcattcagagggtgcaggctaagcgcatggacgagcagcgggtggacctcgccggggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgatatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagaaaaaaaaaa

SEQ ID NO: 399 - DNA, 1124 bp, Homo sapiens
cggctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttaaaaaaaaaa

SEQ ID NO: 400 - DNA, 2354 bp, Homo sapiens
cgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactcccacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaaaaaaaaaaaaaaaaaaaaaaaaaaaaaaaag

SEQ ID NO: 401 - DNA, 2337 bp, Homo sapiens
gtcaggtccatgagctgcccaccgtcctggccttactgtgccccctgccccaccaacataggtgaaagcacctcccctctaaggaagaccatagagaccccaacactgtgggaccccaaagctccttcatgctcactggagctcccaccgtgggtgcttgcaagtcctcagcgctcccggggtacagccctccccttcctgccctctaatgtcctcccctcccttgcccttccctccacttcctttctctgccgtcccctcctctcccatcttgtgacctctttactggcggggcctggagcccatgatggacacttgcggaaggaggggtggcggagcacccctgagatgacatcgctgcctgccccagagcaccccgcctctccctgtgactcagttctttgcagcccagatgtgagcatgtgcaccctgggacctgctgcccgttgggatgcccaggccaaatcagcccctctgcctccatgctgcactgattgcaagagtttcccacatctgcagaggccgtgggctcagccccacaccagccaggccaccagtgttgatagcggtgaggcggggacaaagggaatgtctcagttcacagtgtggacatggtggaggtctcggccttgcgagacaaggcagggggaggggataggaaattgggggtattctgtgactcctgggccaccggggagccagaatcttccagccagactggatgggcagggcttagcttcctgatgccgcccattcaccactttcaccccgggaacctacctgggcatcatgggaggcagagcctgaaccccaacccaaccctaactctaatgctaacccctaaaccatccctcaccctaacccaatcctcgccctaaccctaatgctaacccctgacccgacccaatcctaaccctgatgctaacccctgactcaactctcaccctaaccctgatgctaacccctgacccaatcctcaccctaacactgatactaacccttaacctaacccaacccagccctaactccaactctaaagctaactcctaaccctaggagaggagcccaggccgggccctctccctgctggtttcctgttgggctttggagccccagatgcctgcccagaggcttccttgtgcggggtggggtccagcagtgggggatgggcccagagctggtgtagccaccagcagagccatcctgatccacaggaccatccctggtggggtggggccccctggggcaggaaggccactgaggccagggagactcccaggcccactcacggcgcaggccccacaggagctggctggaggctatgggtgcggggcgtgggcctgccgggggttgcgtgacaggcagtggggagtgggttgtgctggcagctgtgggtgagtgaggaggctcctctcatgaagggccctggggaagtggaatctggccctgagagacccccggcctcctctgcaggggctgccggcaggaggggaaccggggaccacctcccgccacagagcctggggcccccagccttgcctacagggagggtagatgagagtgtaaactgcatatgaggttgggctaaacctggacatgtgtttcataaccaaagcagccaggaatctccggctctgcccagtgatcatctgggcaggacatggggacgagtgtccaggctgaagtcagggcccggccagcagagggccattttgtattgagctccacagctggtcacattctgtggaatgtgcagacgtgcacggcccatcagacagggtctggagtggggctgccatcttgggcagctcctcccgggtgtctgcaaaatgcagaggtcaccagagccaaggcagcaaggcaaggagcccggcttctaaggaactctgagcaggtgtggtccatggctgggaggcagctggccccacagcacatagcacggagggcggcgcggagtcctggacgctcttggcaggtcccctcatggaggatgtgggggattggcttaggcctggtctggctggccttcctggaccgcagtggccaggagctgaaaaccgtgaccccagtctccctgcagctgttcttgatgggatttctgttcgccagtcagatgcatttgcacaggacttggatcctgaactgtgtaacctggagaggcaggtgtgagcgggccatgctgctggcccagcctgtgccggtgtctgtttctgttgtctctcggcccttctgtgagccctcagtaaagctcttcgtgcttcagtcaaaaaaaaaaaaaaaaaaaaaaaaaaaaaaaaaaaaaaaaaaaaaaaaaaaaaaaaaaaaaaaaaaaaaagg

SEQ ID NO: 402 - DNA, 2544 bp, Homo sapiens
ggtggcggtgggcggaactcctagcggacacctcgtggagtccggccggaagagcaaccgagatgaaggtgaagatgctgagccggaatccggacaattatgtccgcgaaaccaagttggacttacagagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagataataacttatatacttttgatatgcgtgcactggacactcctgtaatggtccatatggatcatgtatctgcagtgcttgatgtggattactctcccactgggaaggagtttgtgtctgctagtttcggtaaatctattcgaatctttcctgtagacaaaagtcgaagcagggaggtatatcatacaaagagaatgcaacatgttatctgtgtaaaatggacttctgacagcaagtatattatgtgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacaaaaaaaaaaaaaaaaaaaa

SEQ ID NO: 403 - DNA, 944 bp, Homo sapiens
acgcgtccgggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaaaaaaaaaaaaaaaaaaaaaaaaaaaaaaaaaaaaaaaaa

SEQ ID NO: 404 - DNA, 1169 bp, Homo sapiens
acgcgtccgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagaaaaaaaaaaaaaaaaaaaaaaaaaaaaaa

SEQ ID NO: 405 - DNA, 1641 bp, Homo sapiens
acgcgtccgccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatgaaaaaaaaaaaaaaaaaaaaaa

SEQ ID NO: 406 - DNA, 2869 bp, Homo sapiens
acgcgtccgccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatcgctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaaaaaaaaaaaaaaaaagggcggccgc

SEQ ID NO: 407 - DNA, 1676 bp, Homo sapiens
gctagaagctggagatacagtgatgcacaaagcaaatgtattctgtgtcttcttgattatagtctagtagggaagagaaaaaggtaaccaaaaaattacaatatgatgtaatagattctgtgataggaaggtgcagggaactgtgggaagggatacagaagtgtatgattcaggaaagactatatgaggaggacctcaagcacaagtgggaattaaatggaaggcagaggaggacgagagtgtttgagacaaaagacacaggaagagccaagaatgcaaggtgggaaccttaatagtgtgttcgagaaatcacaagtagttcagactcagcttgaggaggggaccgtgaaagctgagagtgaggcttgtgtgcccccttaaggggcttgctctcctcccaagagctatggggagtcacaggattgcaggcaggggagtgatgcagtcctgtgtgtcttagatcactcaggctgaggcaagactgagacaggaagatcaatcttttgcagtgatccagatgagaaatgatgtgagcctggaccgtgagaaagacgagacagtgtatgcatagggtatagacttgagagagggatttgagatggaatcaagagttgtgttaattcattggcctatcaaacagagaagaaattggagtcaagagtgactcatggccagctgggtggcaccagtcattgagatagagaactaagagaactgatttcccaaagaaaatgagctgttagatttgatattcccaatggacatcagcaagagatgtctactaggcagtagggcacatggatgtgaagcctatgaagcagatttgggctgtagctgtagatctgggtgggggttctcagccctggggcttcaccctatcctcctccaaagccctaccctctgcctgaggccaggtccccagtccctagccccttcccccgccaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagtctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaaaaaaaaaaaaaaaaaaaaaa

SEQ ID NO: 408 - DNA, 2000 bp, Homo sapiens
ggtatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgctccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactggaaaaaaaaaaaaaaaaaaaa

SEQ ID NO: 409 - DNA, 2283 bp, Homo sapiens
atatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacatgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgaaaaaaaaaaaaaaaaaaaaaaaaa

SEQ ID NO: 410 - DNA, 2161 bp, Homo sapiens
gcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggacttagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 411 - DNA, 5379 bp, Homo sapiens
ggcacttggaccgataggtatttggagcatgagttaggaaggatatgtctttctccaggtgcgcagctgaaagttgctgagaaaagctgcctgtgttgctgtggtaacatgagaaggaatgaacagctctatacaaaaactggccacacattataaggcctattctatgcagttatgtttttggctatttgctcatttagtcattgtttatcaaccaaactaggtaagccaaggagttacaagacagctctagagaagctccctctgcttacaggacaataatgcattgtttgttgatacaaatgaattatttgaatccacagaagtgaaaaagggaaaaaatcctggctgacttgtgggaagagcgtactgcagagcctagggcctgagttaactcgctggcggccctgcaggcaggcttgatgggagcgcccagcacatctgcccaccctgcacagggcatgaagcaccgtgtgcagagatctgtgagcaaaagcccaggacgtgaccttaggcaagaggggtccttggagaagtggaggtgtgcatggtgtgtagccttgcgtgtctgtgagcacgccctagtggacctgcgcctggattatcgggccagtctctcggaggggtccgtgatgctgagttacgccattcacctgaactctgcagctcatcggctgtaggatttgggtgagacacttttccttgctgactcatttccccatctgcaaaatgggggtgacgatatctacctcttggggtgtgtcaagggtaaaagagcacactttaagaatcctaaagcactaagccaaggatgaaagactagaaagctgcctctatgttgctactctcaaaaatgctcagaaattttcttgtcgtactaaaaatgtgttatttttctcattttcattcttccattcaacacagaagtaatctaagtaagttctaaaaacatagatccgggggcccacagacattcaattttcttctgaattggctctggtatcacacaacacacaagcaagcaaacagcctgcctgctagggccttgggttccaggctggaggaatgcaggcagaaatctcttaggaaataactaagtgagcgccaagttttgaattgccttagagccgaaagagaatgtggcgtgctggggagagatctggacctctttctcatcagtcatttgacctgtccacgaagaacaattttgttatgcagcctgggaacctggtttccttacaccctgcgcccttaatgacacagacaaccacgggtactcctggacggaagctcatcacgcctcctcaaataccttcacccatgttcaggtcacacggaggtcaccatctcctcagcacacaacaactgctttggttcccagggttattttttctacgagttgaaaacccacggagcctaagccatctttttgtcccctaaggagagccccatagactaagagctacacttcctgtctgtctttcccacctttccatctcattctagcttaaagcttatcacgctactgagagcctgttctgtagttcaaggtggcagagaaaaatacgaaccttgagtgaaatctggagagcagtgcagggtcatccccagacgtgacgggccatatcctaggcgactcctgcagcttatagaagcagggaatttaatggacttcttccaggaaagccagcccacggggactcttaaaaagacaccaaccatttggaagatgcagcttgaggtctgggggactggactgattctgccaccatatagtgaacacgattaatcgggaggaagaagtaaggcactctgtgagttagtctaccaccctattgactttgacagagagaaaaccaacttttttcatatgatcacacagtagtactggaatatctcgactgcaatatcctctaaacaaatgcatgcaaagctttgtaaaagcagctgatgattaaaaaaattttaaaacattagggtttttctaatatatccatatgtgggacagtgatttaaatgtcattaattgtccagccacaacttgtaacagtgatgtgaaagacacaaaaaaggccccactggagtggaggagtggtctggctggtccccaagcaaaacagaatgggcttcgcataggctttagaacttattcataaatattgaccaaagtgtgaagcaaggtatccagtgaagattctctagggtctctacttctgctcaagagatttaatccagctttctctaaagcagtggtccagacttgccacatactaggttaaagataaagtgagaaaaacaaatactttggtttgcacgtctcttgaggggccctaggctgtatggaggaatatttagaggaatatttgtgagctgccatttgtgtttaaaagaacatgaaagcaagacgggccctaacccgcctgtgtctgtagctgaccaggaggccactgcttccttcccccagagcttctaggagagccccccaaaatgcaactctccaaggtcctgtggagtagtcccctcataatgcctccaccacacctgtgtctcacgatgccttaactgacgtagctcctaagtgatgttcacagagaaggaaatacttaggcaagcccatgtgtaacatgctcacagatgtgctggctttgccaatgctttcggactccaccatgctttctgattcttctggtcctagtcacgccttggcacggggcagaagcggccgagctatgctgacaggtgctgctgagagccaacagccattcagccgagaaggcgtttctaggtgagggcatgagagctggcattccaggctgctgagtgcggcatctgcaggtgcaccacattgctccacggtgtgttcagaagagaccagcatcttgaatctcaggctctgggctcattctttgcctctgccaagggaccattcaggggcttcaagccagctgctgaaaatcccccttttctggatttttccccatctatataaggatatggtggctgtgtggacaagaaattggtttcatctcagaagggtgcttccctacaaagatcttcagaaatttaattgaaaacaattttttgaactttttttgtttggccaggatgaatgaagctgaagtcacatcctgaatgtgcatgccagacaaagggtaagcaagcagtctttacaaatgccaatccctctgcactccaaaaccggagcccgtaatgaaggcccaggttccagtcatcacaggatcccccaagccagcacagtgcctgatgcctccctaggcattagcacatcccagcactctaattcacatcctcagcatccctgcctcctgcatccagggcttaggttgagtgtttccagagtgtcaagtacatttaaacacaaaccaaatactccagggttttgacctgtcacaatggcttttgaaaacaacagacgtacaatttgagagaaggactcgatggacttcttaggctgaggactaaggacatgttgctgttcctcttggtccaggacattcaataccattcacagcattcatcaccaactgacatagtatcgatcacgacattcaactgtttgaaattactgctattttggtcaaaaactaagaaatcagaaattgcacctacatagtgtgtctcctcattggagtcccatctctctgagcacagggatgggctcctgagctcacagccctgccctgcccccccagcagggcctcaccctcatggccctcagtgaatagtgactacatgaagggggcacttactagaggcctgagtaatggaatttcaattagcttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagctcctgcagcctcatcctagtttaatatgaaggttgtgaatgggttaaaaagcagttcttaagcacctacttagatcttttcagtatctggaaatagcacccagggctgtgttagtaaagcttttcactgggtaagagtcatacaatttttacatttaatttgtttttttaaaacaaggcagtcttgttttacatattggaatgactagatattttttgacatttctggcacctctggttctgctgaattttaagggaggtgagtggtatgtacacaaagttaagattgctgcataataattcctttgcatttccaaaataaattacacaaatgtcacttttccttttctattccatagtactagttttagccagatctttgccaaacattctaggacattcagaaaagtcatccatggaattttggaatgccattctctctgtatctttgcagatcatgaggaaggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaaccatgggcaagggtggaacacacccggttcaggtcagggaatgagttgctctaagtgaacagtgaattcttacttctcagcctgtatcaattgtacccagggttcatgattactgtgacccactaagggacgatctttgaggaaacagacctggagggaggtaatttaaggagggaaagtgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 412 - DNA, 3642 bp, Homo sapiens
atctgagttggtgaggcagttggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaataataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagatttgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaaggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaaaaaaaaaaaaaaaaaaaaaaaaaaaaaaaaaaaaaac

SEQ ID NO: 413 - DNA, 2134 bp, Homo sapiens
ggcacccaggcctgtgagggaggctggtcccatggccttcctcttccaccaccaccaccggctgcccaggtggcccccatcgtgtccccagggaacgctgggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaacgcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacggctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcacctcctgccagcaagtccaagaagcgacctctctttggaagcccatcccctgctgaaaagacaccgcacccagggcctgggctcagggtctctggggagcaatccctggcttgggggctgcgtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatgaaaaaaaaaaaaaaaaaaaaaag

SEQ ID NO: 414 - DNA, 2327 bp, Homo sapiens
atacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacactggctctgccttgttacagccccctcttgaacagcataccgtgtgtcacttcttctctctgaatcagagatgtagctgccccgatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcagaaaaaaaaaaaaaaaaaaaaaaaaaaaaaaa

SEQ ID NO: 415 - DNA, 1274 bp, Homo sapiens
ctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattcaaaaaaaaaaaaaaaaaaaaaaaaaaaaaaaaa

SEQ ID NO: 416 - DNA, 1453 bp, Homo sapiens
ggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggaggtcagagaggcagaaagccccggtggccgtggctggggactgtgggactgagggggcctagggaggagggtgcttccggggccgcggtcctcagcgcctaactccacccagctccacctctgcaggggagggggtatcgggactgggagtcgggggtgggcttttgagctctaggcgccagttctcttgagcccgggagcgcgctgtctttgctctttttttttttttttttttggtccaactcgcccgcccctttttttttttcccacgacgccgcccccctccccctggctctgtgcctcctcagaggtccgaagttggggtttgcgtccagggttttgcctaggcggtgactggactctaattcttaccgcaggaattgggtgatctctttcctcttttccctcaatttgtatttcaggtttgggcacataaccctccctgcgctacactccccattttctttggggcatgggaattccttgccacgctcagggcgtgacttttttttttcaaactttctctttttgcctccttaattgatcgccatctctttactggcccctcagccacctgccacttcccccaccaggtctttgaagtggggagagtttcccctcaatttctagaagggatgggaagcaaaagagggaaggaatcttgcttttgagaaatgtgtgtttaaggttcagtgcagggttctggtgagagtaaaaggcaagttagactggttataaaaatccagcgctttaggggtttccagcaaagactgatagcactaatgttgacaaacatttagggggcacacctttattctacagaataaagtagaccgtgtgaaacagaccatattaatcattgtattattacaaacgtgtgcaaaaaacgctaagaggggtcagtggaagagcatactgatgggggtggtgagttcatctatggaagttcaagcctaacccgggaagtgctgaagccctcatccggctttcaggctttgtgaaggaggtgaattttaatctgggctccagcagagtacaggggatttgaagttgtcaaagaggagggagaaaatgcttcctgctactgagattggactttgagaagggtaaacagaagagggagcactgtgagacaggtgggcttgcctgattggaataaaagatatcagcacaaatatactgggaaataaatagggtggagaagcttggggtcataataacatgatactttgaaacatacacatagtttggatattattctgtatcaaataaaattgaaggcaaaaattaaaaaaaaaaaaaaaaagg

SEQ ID NO: 417 - DNA, 1612 bp, Homo sapiens
gttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaaaaaaaaaaaaaaaagg

SEQ ID NO: 418 - DNA, 2937 bp, Homo sapiens
ccacgcgtcgcagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttttgcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaatttttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaaaaaaaaaaaaaagg

SEQ ID NO: 419 - DNA, 1231 bp, Homo sapiens
atggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaaaaaaaaaaaaa

SEQ ID NO: 420 - DNA, 7028 bp, Homo sapiens
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaaggtgagtggcccagtggggacaggtggtgctgacgctctggggcaggtagggttgctggagatgctggtgagatggtgggatgcaggtcgtgcagtgaattcctggaggacccctgagtctgggtgatcctgtgtgtcaagggataagcccggggcaaggagggcctggagtacctcagagacccagtgtcatcaaaggaataaacacacccccacctcccaggatgtcagaaccagagagggtttccagagcctcagcggatggcaaacacaggctgcttgtttgtagctgggccagagggagggcctccaggtggctccaggcttctgggagaacaaggccccacaccacacttcttcccccagcacccagtagagtcctctgcagagtcctttctgcatgccaggcgctgagctggtggctttacctgggtcatacccccccagtgagatgggcacactaacttttatggccgagggcaccagcccacagagacggagtgtcttgcccagggtcccagagaagcaaaggggctcagcctctgaaccctggcctggatccacagctgcccgtctctgccagcctctgcagctgtgttttcttttggctggaaacgggatagatgtgacgttggggagggggtgctgctgcttctggaagacgtggcgtcacagagccttgtgcccgtgggccatcttctccgcccgtccctcttctgagtcctggtgttccccgcagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatatgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcaggtgctcccacgacgcacgccctcctgaggccccggggactggcgagtcctgggctgtcccccaccccaccccgctggtcctccaccccactgctgcctctcctgaggcttcccaggtctcggccccagatctctggctcgtggttctggcttggggcctgggaagctgtctgtgcctagagcctctgttggttgggatggaagctgtgagtccagggaacctctgaggagcctggtggccctgctccacccacgggccgtgctgtcaccagccacaaggtggcgccaggagtctctcccagctctagccattcctgctgggccggggattcccacagggctgtgctccagaactggctcccagagccgaggatgatttgaatgggcggctgcacatctccaggtctgtggggtgggaggtcagttgggtgggaacagttcaactgtactcctacttccagcttcttccttgaaagctgcaggcagggctcgcccgtctgtcggtcagacgtggagatggcatttgtggggaaggcctccctccagcccctcctctggagactgtggactcgtggtggggtggggtgtcgaggagaccaaatcccacgagcccggggagcaagctctgcgtcctttctttttcgtgacagctcaaacctggcaaagaagataagcttttcaggaaaaaggtaccatcttcccctccctcctgtgccccaggcctgagcggttagagctgcaccgcagctccctgggccacagtcccgtggcaggggggcgggaggccttgggcgggcgcagccctgagccccagaggctgacgcgtctccgctctcgccctcagcggcggtcctggaagaacgccgaggaccgcatggcgctggccaacaagcccctccggcgcttcaagcaggaacccgaggacgaactgcccgaggcgccccccaagaccagggagagcgatcactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccaaatgcgggatctcctgtccccgcccacagacaacaggccaggtgagttgccaggctgggggtttctgtgggggtggggtgagcgagctagactgttggatctgcttttaccctcagaccccagctgttccccaaaggacatagggatgagtctctgctgccatgttctcagtttgcttcaggcacagaggggatctgggaggaggcaggggctcctgtgcacacgtgagactcgctcctggggctccgcgtgcgtctctctgctttcctgttgactcgctcatggggctctgcgtgtgtctcactgctttcttattgactcgctcatggggctctgcgtgcatctcacttcttttctgttgacttgcccctcgttggtttcaagcctccactgccatcgggatcagtgtggttgtgcaaaggcttccaggatggcacctccccctggactgggctggactgcctaggtccgtgcttctcgccaagccatggggatcggagatgctgcgcagcctctgcactggttggctgatgactactgggtggaatgtgggcatagtgtttctaggtcttttagtttttcaagagaatctgaaaatctaagttttgatgtggagtctgatttttcactgttggaattatgattttgggaggaagcagtttataactaaatgaaatctgagtgttctgtctggctggtgggccttttagagtgtcatgtcagcatgaccaggcctcctcggtcagattgacgggttgccccctccttcctgccccaccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccaaaaaaaaaa

SEQ ID NO: 421 - DNA, 1070 bp, Homo sapiens
ggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagtttaaaaaaaaaaaaaaaa

SEQ ID NO: 422 - DNA, 1623 bp, Homo sapiens
tggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaaaaaaaaaa

SEQ ID NO: 423 - DNA, 1412 bp, Homo sapiens
agcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacatactggaaaaaaaaaa

SEQ ID NO: 424 - DNA, 1073 bp, Homo sapiens
caccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaaccatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaaaaaaaaa

SEQ ID NO: 425 - DNA, 4018 bp, Homo sapiens
ggcagcaggccgaagctcttcttcttccgctcgctcttggccttggttggccgcagcttgcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcgggggggaggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacccgagagaaacgcaggtgttccagaggcttccttgcagacaaagcacccctgcacctcccatggctcaggatgagggaggcccccaggcccttcgggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaaaaaaaaaaaaaaaaaaaaaaaaaaaaaaaaaaaaag

SEQ ID NO: 426 - DNA, 1337 bp, Homo sapiens
ggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgccagaagacgcccgtgctggagtgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagccccgccgccaacaggccagggggcccagactggcccacgtccccatgcctgggtgctgtgaggcctgatgaccaggctggaaaaacccaaggttgggtccagggcagtggccttcaatcaagacctcccattgctgaacccacaaccagggctacccagaggcctgaccctgccagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctggggaaaaaaaaaaaaaaaaaaaaaaaaaaaaaaaaaagg

SEQ ID NO: 427 - DNA, 1644 bp, Homo sapiens
caggctttcagcagccacccctacactagtgggcccagtgcctgcaccagctccttgagcttctccctagtggggagcttcactgtgcagcttctggggtggcctgggcggaggctatggtggggccagcagtatgcgaggcatcaccaccatcacggtaaaccagagcctgctgagcccccttaacctggaggtggactccaacatccaggctgtatacacccaggagaaggagcagatcaagaccctcaacaacaagtttgcctccttcacagaccaggtatggttcctggagcagcagaacaaggtgctggagaccaagtggagccttctgcagcagcacaagatggctgggagcaacatggacaacatgttcgggagctatatcaacaaccttaggcggctgctggagccaggagaagctgaggctggaagcggagcttggcaacatgcaggggctggtggaggacttcaggaacaagtatgaggatgagatcaataagcctacagagatggagaattaatttgtcctcatcaagaaggatgtggatgaaacttacatgaacaacgtagagctggagtctcacctggaagggccgactgtatgaagtggagatccgggagctgcagtcccagatctccaacatgtctgtggtgctgtccatggacagcagccactcctggacatggacagcatcatcactgaggtaaagaggcagtacaaggaggttgccaactgcagccgggctgaggctgagagcacgtaccagatcaagtatgtggagctgcagacgctggctaggaagcacagggatgacctgcggcatacaaagactcagatctccaagatgaaccggaacatcagccagctccaggctgagattgagggcctccaaggccagggggcttccctggaggccaccatcccagatgctgagcatcgtggggagctggccgttaaggatgccaatgccaagctctccaagctggaggccactctgcaacgtgtgagtaccaggagctgatgaaagtcaagctggcctggaaatggaggtcgccacctacagaaagctgcgggagagctaggagagccagctggagtctgggatgcagaacatgagtatccatacgaagaccaccagcggctatgcaggtgatctgagctcggcctatgtgggcctcacaactcgtgacctcagctatggcctgggctccagctttggctctggcacaggcttcagctccttcaggtgcaccagctccaccagggccgtggttgtgaagaagatcgagacccgcgatgggaagctggtgtctgagtcctctgacttcctgcccaagtgaacaactgtggcagctcctcctagtctgcccctcccgtggctgccacagactccaggagggaggctgctgtgtggggaagcacagacaacaggagaccccccacctgaggctcaacccacccgtgggggagtttactgtctggggaccccccttgcccatgcttccagctagaaaacaattgtggttttttttttggtccaaaataaaacctcagctagctccaccacaaaaaaaaaaaaaaaaaaaaaaaaaaaaaaaaaaaaaaaaaaaaaaaaaaaaaaaaaaaaaaaaaaaaaaaaa

SEQ ID NO: 428 - DNA, 4502 bp, Homo sapiens
aggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctaaaaaaaaaaaaaaaaag

SEQ ID NO: 429 - DNA, 4126 bp, Homo sapiens
cggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattgagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtatgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaaaa

SEQ ID NO: 430 - DNA, 3074 bp, Homo sapiens
gaagtggggatcggcgagcgggtgggtgcgcctcgggccgcgggactcgcagccgccaccgccgctgccgcctctacggccgcgtcagaactgaagagaggaaggggaggagccgagtcgagcctaagctgccgcccgatcttacccctgacccgagggcggcctggagagcttggtctgtagcggtttccttcggggcaggtggggactgctcctttgggaggaaggaggaggcccaggccgcgtcttcaggcagctgcgcgcaccacccgaaggtgaggcatttggccccaaacagaccctcgaaaagccggactgatcgaggagttaccctacagcctgatctgcacctgctccagggagagagcgccccacccttcccgtggcgtggggtgagacccagcgttggataacgtgtggtcgggccgagcaaatgtttgatgaatgaatgaatgaatgaatgcctctctcacgtggcactcgtgaagctcagaggatatggtggaagtgcaagcgctttgtaaactgcagtgcattgtaaaaatgagttgtaatacattcctcccctccccctagccatgaaaggaaacaggggtgcggcttgagtacagagtcacaacctgagtctttagtggaaaaggagacgaaatgccgagcaagggaagggacccatcctcgcgcagattgttagggcggcgggaagggaggattggaagggagccatcctctgggagattgctgaaggatttttgactgtcaggggaagaatttaatagtccctcacttttacgaatggttctttcttacggtttggagctttcgagagcttctggtcttggttcatcagtgtacgttgtcatcaagaaatgttggcctgtttcaggtctgactcaaaggttattttctttctaaaataagtgttattactattatgcagcttttcctacagatgttatcctggaaaggaaagttaagtagaaactcatgaagtttaaagtgtagttctctaggaaaacaaatttaagataaaaggaccagaatcctcagaaatctgtcttcagtgaatagtatgagaaaaagattaaagcagcagcaatgatgaaagcagattccacaattctgtccctggaccctagtacactctacctccttgggaagcagtagtaatggattttacaagtctttccacctggaggagggggtaaggtaggagcaagtgtattatagacaaatgtgggaagctctgggtttctcccactactgccactaccatctgcaaacagtaaactaaggaaacttttaactgggtaaatccaagggctcgtgttcattaaaatgctgcgggaaaggtggtgagaggggcaaaggaggatgtggcaaaaccaaggagagactcacagactagcacctgaccctactgcccttgacctgaagttccaagagccaggttaaatatcctgcttaaattaccctggatttttctgtctttacgtgaccaatcccctgctacagccttccaaataagactcacaggtaatcagaccaacaagtgatggtctcacatggctacaaaataaatattttttgtttttccccctcttcctatcttacaacaggggaatggtggaaattaaaggagtaaaacacacagatttaggggattttgtgaagctaaacacctcagagagtttaacctttgtaggctttgaaggaaaagagtgcaaacatcagagttctgcagcccagcagagaacacctccagttaagtgtgtaccacatagggtttttcagcagcgtgatcttctgttttcattgtcagtggctccaccttacaacctcagtgctgaggaacagaagggcactcaggagagcctgagccacttacttagaaagtatttaataacagcacactaagcttactgggctagatacccacctcagcacccagcttgataacaggaggaaacagctggaactggagactggagagaaggaagttcatacatttccaacttggtctgcatctctttagttccttgtattgcttattaatccagaggagaaaacagctagttaattaaaaattccaaaaaatctgaagttttagctaatagttacttccctggttcatcaatttaagataaggatctaaatactgtgttaaaatatagaaaaacggagactcttataaggtttttgacctctacacttgaaagtgagctcttacaagaaactaatcagtgtttcgttattccatatcagtggcttttactgtcaaagattgtgtaagctaaattatctggcaaaattttgctttccagaaatactatctatattaattttaacatttttattgtgaaatatagtttaaatacataaagcaattatatagtataagtgattataaaggaaaccaccatgtaaccaatcaaccaggtcaagaaatggaatatttccagcaactcagaagttcccctccctgccatgaccttcccgaacacaactctttccctccctcctaagtgtagtcattattctaacatttgtgataatcatttccctgcttttctttgtcgctttgtcgcaagcatgcatccctaaacaatatattgtttagtctcactctttcttttgaactttatgtaactggaacaatataatatgtaatctgttgttcttgctgcttttgctcaacattgtttttaattcatatgttgttcaggttgttcctatagctgtaatttgtgcattttcattgctgcatattacagtgtcccattataacaatatgtgacaatatgtttagccattctattgctgatggacatctgggttgtttccagtttaggattgttataaatgctaatgtgaacattcttcatatatgtattccatcacatctacgtcagtttctgtataacatatacctgggagtgtaatatgtatcataaacttgaataaataatgccaagttcttttctagagggttacacagtcacaaaaaaaaaaaaaaaaaaaaaaaaaaaaaaaaaaaaaaaaaaaaaaaaaaaaaaaaaaaaaaaaaaaaaaaaaaa

SEQ ID NO: 431 - DNA, 1435 bp, Homo sapiens
ggcagcccttttctagatggagaaaacagaacctgaagacacccgtttccctaaactgctctcgctcatgtttctacaaggcctggagctgataggaaaaacctcccttctttcccaaatggtccccagctgccccgttcactgaaggccctgcagtcaggaacggtcaggacttcacacccagttgttgtgggtgtttggccgacacgacacttcctcttgtgtgattcatggacccgcagcattgcgtcacctgggagcttttggtattgaagactctcagggctcacccggaaggacctgctgggccagaatctacattttaacaagatgcccagaaactcctggagggcagaggcatgcctgccatcttcatcattgcattaccaccacccaacactatcgggggacctgccctgataatcagtctacaggtgtatccagcagctccagagagacagcgaccagcgagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaaggtttaaggcatgtagggctgtgcaggacgtgccttgttaaccaaatgtttgcaagcagtatacttggtaaaagtcatcaccattctctcatctcaataaaccaggggcacaatgcactgtggaaagccgcagggacctctgcccttgaaagctgggtattgtccaaagtttctccccatgtgatagtctgaaatatggcctcgtgggatgagaaagacctgacggtcccccagcgcgacacccataaaagatctgtgctgaggtggattagtcaaagaggaaagacttgcagttgagatagaggaaggccactgtctcctgactgcccctgggaactgaatgtctcggtataaaacacgattgtacatttgttcagttctgagatgggagaaaaaccgccctatggtgggaggcgagacatgtttacagcaatgctgccttgttatcctttactccactgagatgtctgggtggagagaaacataaatctggcttacatgcacgtccagtcatagtaccttcccttgaacttcattatgtcatagattctattgctcacgtttgttgctgaccttctccttattatcaccctgccctcctactacattcctttttgctgaaataatgaagataacaatcaataaaaactgagggaattcaaaaaaaaaaaaaaaaaaaaaaaaaaaaaaaaaaaaaaaaaaaaaaaaaa

SEQ ID NO: 432 - DNA, 2185 bp, Homo sapiens
gacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtaaaaaaaaaaaaaaaaaaaaaaaaaaaaaa

SEQ ID NO: 433 - DNA, 1453 bp, Homo sapiens
aataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcaaaaaaaaaaaaa

SEQ ID NO: 434 - DNA, 3301 bp, Homo sapiens
ctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctggggagcccttccttgacagcccgggccgagaagagtccctgcaggaagcatcacccaggctggcagatcatggtagcagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcacctacgcggtgctgtcctcctccaacgtgcgcgtcataaaggacaagcagaccccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatacgttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcaaaaaaaaaaaaa

SEQ ID NO: 435 - DNA, 1442 bp, Homo sapiens
aaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaagggaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttcaaaaagaaaaaaaaaaaaaaaaaaa

SEQ ID NO: 436 - DNA, 1905 bp, Homo sapiens
cttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctcctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcaatgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttcccaaaaaaaaaaaaaaaaaaaaaaaaaaaaagaaaaaaaaaaaaaaaaaaa

SEQ ID NO: 437 - DNA, 3913 bp, Homo sapiens
gggggggcctcagggaataaactgtttcttgattttcagtcaatgaaaattattaaagagaatgctgatgaggacagtgcaagtgatctctctgattcggaaagaattcccattcctccttctcccctcacaccaccagatctcaatcttcgagctggagaaattgatccagtatactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagttctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgagatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttgtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttgttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagatatgaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaaaaaaaaaaa

SEQ ID NO: 438 - DNA, 1363 bp, Homo sapiens
ctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaagtgggtgccagggagggcaggggaaggaggctgggctggccaggccaggcccagccccaccctgagccattgcctttgcccgcagggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaaaaaaaaaaaaaaaaaaaaaaaaaaaaaaaaaaaaaaaaaag

SEQ ID NO: 439 - DNA, 2014 bp, Homo sapiens
atgaatattgtatgcacttggtattgttccattcattctgcaacattgttttctacctgtacattacatgcatatttcatgtgtttcttgtgcatgctatatgcttcatgtggcatccatgcccatgcaccacatatgttacgtgtaaactgtgtggtgtgtgtgtggcgtgtatgttttggtgttctgccttcagacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagggatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgccagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaaaaaaaaaa

SEQ ID NO: 440 - DNA, 4018 bp, Homo sapiens
gaagaagtcccgggcggtacccggccgtaggcccatcctgcaactctctccgccgggtcctcggggcagcacgccgggccgggacccggagccggaacccgacactgagccggactcaaccgcggcggtccccagccagcccgccccgtcggcggcgacgaccaccgcggtgactgccgccgcggcctcggacgactcgccttcagaagatgaacaggaagcggtgcaggaggttcctagagttgttcagaatcctccaaaaccagtcatgaccactagacccacagctgttaaagcaacaggcggtctatgcttgcttggtgcttatgctgacagtgatgacgatgacaatgatgtttccgaaaaactagcacaatccaaagagacaaatggaaaccagtcaactgatattgatagtacattggccaacttcctagcggagatcgatgccataacagctcctcagcctgcagctcctgtaggagcttctgctccacctccaactccacctcgaccagagccaaaggaagcagcaacatctaccctttcttcttctacttcaaatggaacagactccacccaaacatctggttggcaatatgatactcagtgttcactggcaggagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataaaaaaaaaaaaaaaaaaaaaaaaaaaaaaaaaaaaaaaaaaaaaaaaaaaaaaaaaaaaaaaaaaaaaaaaaaaaaa

SEQ ID NO: 441 - DNA, 2062 bp, Homo sapiens
ctggtgaaaacagataggaaaaggaagttgcctggttttgttggaacctatggtccaccaaaagaaactgagagaggtaagactgtacaggaaacctaaggccagttacggccagcattgagcatcacgctaaagggaaggaattttactctgggaattatgagaaaccattttaagtttctgagcaagaaagacaagatggccgctgcacgcagaagggcctggagagagggggaacgggcagcggggagcctcacaagaggactacagctggaaccatggcactggcagggggcatggaggagaaagagaagaaaaacagtaagcaggcaggaccatccgaacagatcctcaaagctgccatggacctcacttccctgtccccacagggaggctgctggagacagagcctatttggggaacacaaaccacgggtctgacacgtctgagatgagctgccgagcctctgcctccactctcattcagacactcagcttttccgaactactccaagcaccaggctgatgaggacatgggaaacccacgctctggcaaagccgggcccaggtgttgaacccctacccagacgccttccacctgaatccccacccaggactgtgtccaagggtgggactaggcggctctgcccctagagccaccttcattgcggcagccaccactgtgcctgcctctgctgtgcttttgcccccccttcccctcctccgtcatagcccccgccccccgcccactctgcggaactggcacagcaggacagaaaaaccaacgccaccatgtcggagaccagcagaaatggctccaaaatggcagctcatcagaggagtccagaaagatcataaacccacccagggaaaagaggggaagccagtgacaaggggagtaaactgtcaaaactacctcccaaccaagcccccgataatcatcacatcttttccttcagaaacatcctctcaaaaatcagatgggacatgagtgaaagaagggtgccaccccctccaccagagaggccctaggggccataggtggtatggggcactcagaaggatgttctgtagcctcttccccaagatgaggctagaaaaccaccacttttgtcctcaagcttggctcctgccagtaactagacaagagttagccctcccagggattgcagtccttcactgctacccagtcagaccctccccagctctatgggccctggggagcaagaaggtagggttgcaaggaagggccgagaaggcgcgtgccatgccctcagttatgtaataagaagggcggtgctcgtcctaggccagagacccagggcgcactgcgcttccagatgcgcagtcacgggtgggggccactgcgcatggcgcagggcttggtaaaccccctccccacaaacgtgagacctgcgacaaagacaggttagagagccgggaccctgatttttcgaggcctccctcccccaaccaaaggcggacagcctgctgccctagttttattctgattctcctcattccctagactgacaaacctttctaacccggggcctccaaacctcccgtctcccactgacttttctggaaatcccaccagatgcggagtttcgagcaatttcctggggtcagtcccccatcctcacctttccaagcaccacgtagtagtagcttccagaaggtagatctttcccatactgggctcagctcacaactggctcttgagggcctctggacagccccggacgtcaatgcaaatctgttgtccccagggagtagcccagagtcagcaggaagcccagggtggtggcagtatcagcagcagcagctctgccctaccttgcccatgcgtttccaggggagccaagaattattttgccgcaacactgaggtgtggctgattggaaaattcccttttccaacaccaaactacagaataaatattttcttccaatttggtcaaccctctgcatacccatctccctagcattcttccctctaaataaaaagttttgggagccctgagctcttcctccttaaaaaaaaaaaaaaaaaaaaaaaag

SEQ ID NO: 442 - DNA, 2266 bp, Homo sapiens
ggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagttttaaaaaaaaaaaaaaaaaaa

SEQ ID NO: 443 - DNA, 1200 bp, Homo sapiens
cattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaaaaaaaaaaaaaaaaa

SEQ ID NO: 444 - DNA, 2208 bp, Homo sapiens
aggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcgcacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcggctgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggccgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccaaaaaaaaaaaaaaaaaaaa

SEQ ID NO: 445 - DNA, 1439 bp, Homo sapiens
aagcattgtaacttactaattagtccctttgctattgaactttggaccatttccaatttcccactcctgtaattgtgctgaagagaatctctgcatccatgcatctctagagcaacagactcctagaagtgcgatgtctggatcaaagtgtgtacagatttttgaagtgttggtcacttttctctatcagaggtctctgtcaaaggtgagccttgtttgggaaatcagcgccttgcagagatgctggggtcgagaccccagggagaacaggcaggtgagctggtagtggagcagatcacagtgccttgcaaggaacccctgagccaggaagactccctgcaccaggccctaggaggcctctgcctactctgcaactcggcttctgagccaggccaccgggccctgccattcatggcagaggagtgtacatgttacctgctggctctctgcacacagagccccccaccccctcgcccctgatctagaaagaacatcagagcatcaaagattggattattgagctagatagtcaagggacaaccttgaacgtgtttgttccaggggaggttcttagttcggaacccatatgagctagcctaagccaaagaagtctctatgaaccatatccggggactcatggaaactgcagcaacgtcagagcatcaggcttgggtttggagctgggaacagcacccacaccaccgcttagattcctccatccatgaccccctgcccctgtcaccaccccgagctgtgtggctggtgcattcagcttctccatggagagggctcagcctgccataactccaagtgggaggaggggtgccagtcctcccttttctaagtgtaatgccaggggaaatccctcgatctcaggctgtcggtgaggctgcagtcactagcctgtcttttgcctctagggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 446 - DNA, 1904 bp, Homo sapiens
gggaatttgaattggaatttacttccagctgcactcatgcaagaatttgtgatgtatactaaaaaataaaaaaaggctcattcaggagagccttgtactcagcaagagtggctaacattagagcatacagactatgtgattgtataaggcatggagagttaaacaacctccagtcagctgcctgtttgaataccactgacttgttaagaatgatcttgcttttagattttaccatattcaaacttattaggtgagccttatatagcatatatacctggctgctattgtggggtttgggaacatgaggggtggggtgaactgttgttgttttaggtttcagtcagacagacatccctgtgcctcagttcccagaagcacagcaggcctctaggagcatccgtgggaacggcgcagtcctgacatcaccaactctcctgctcaggctcatcccatatacagaggtcaaagggtggggtttgatatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgctattacatttgtcattctgtctccccttttcccctaattcttttatgtatgtatgtatacagtttgaggaaatgtgcatctatggtcagtcctttttaaaagacttaatgaatttattactcttttgcaaaaaatatacccactgcttatatgggcatacaaatgctaccctattttaaatgtaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaaaaaa

SEQ ID NO: 447 - DNA, 3003 bp, Homo sapiens
gcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcgcagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggcctcacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtgaaaaaaaaaaaaaaaaaaaa

SEQ ID NO: 448 - DNA, 2955 bp, Homo sapiens
ccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcaaaaaaaaaaaaaaaaaaaa

SEQ ID NO: 449 - DNA, 1489 bp, Homo sapiens
ctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaaaaaaa

SEQ ID NO: 450 - DNA, 1966 bp, Homo sapiens
ggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggtacacccctgccgccatgctgcccgcctcggtcctaggagcttgggggaggccgggcaggggtcctgaggggcagacagcaagcaagtccacaggcaaagctgggatcgttcactcgcccctggggtcacaagctcagacctggggcctgtgggatgagcagtgaaaacaaacgcaggcagggccgctggccagcaagcaaccgacgggcctgattcaggtctggggcccccggagcaggcagtgcccacggacctctgtggtgctcacagccccagagacaccactgaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagcaaaaaaaaaaaaaaaaaaaaaaaaaaaaaaaaaaa

SEQ ID NO: 451 - DNA, 3091 bp, Homo sapiens
ctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtggttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaaaaaaaaaaaaaaaaaaaaaaaaaaaaaaaaaaaaaaaa

SEQ ID NO: 452 - DNA, 1911 bp, Homo sapiens
atatttttgataattgccaaaatacactttttttgaaaaaagacatttggaattgtttgaaaaactatttaccttctataatcattttcctaaaaatactacattggaaattgaaaaaacaaaagatatcaaatataatgaatatttattcaaaaagattacaatgtgattttctttttctagtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctaagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 453 - DNA, 3617 bp, Homo sapiens
gctgaaccatggcgccaccagagggcgcgcgatcccgccccaaccaacttcccgctgaagtgccagaagcagcgaggagcttcaacttcctcagggcagcacggggatcgtgttaatttggtgttcttcattgatgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagagagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaagaagagaaactgactgggcaacatgttattcagaaacaggaccttgccctgtcactcaggatagagttcagtggtcctatcatggctcattatagcctcaaactcccaggctcaagcaatcctaccatgtcagccttcccagtagctgggactacagataccgggtctcacactgtcacccaggctggagtacagtggcacaacctctgctcactgcagcctccacctgccaggctcaagcaattctcctgcctcagcctcccgagtagctgggattacaggaagtgagctcacaatgactcaagctgccacatactgttgattgtgaaatgccagttgaagcatatgtcctgcaagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcgctgtagctttggccttctgagatcaagcaatcctcccatctcaacctcccaagtagctgggactacacatgcatgtcacccatgcccagatcatttttgtagagtcagagtttcaccgtggtggccaggttggccatgttggccaaatggggtcttcttttgttgcccaggctggccacaagttcctgggctcaagtgatcctcccacctcgtccttgtagagatgagatttagttatgtcgtccaggctgatctcaaactcctgggctaaatcgattgactcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactcaaaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacgtcgacctcccacgtggctgagactacaggtgcttgccactatgcccaactaatatttggaattttcatatacgtggattccagaggggtgacagcgaaacgtgactgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtagtctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcacagctacttgggaggctgaggcaggagaatcacttgaaccctgaaggtggaggttgcagtgagcagagatctcaccagtacactccagcctgggtgacaagagcaaaactgcatctcaaaaaaaaaaaaaaaa

SEQ ID NO: 454 - DNA, 3538 bp, Homo sapiens
cagagagagaaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcccgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggctggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcaaaaaaaaaaaaaaaaaaaaaaaaaaaaaaaaaaaaaaaaaaaaaaaa

SEQ ID NO: 455 - DNA, 2744 bp, Homo sapiens
tttttccagtatagatagaaggggcctcatgcactagcccaagttctctgaattaatcttagataaattaaatactttgtaaatattttaatgattataattgtaataaaattattattttttctgttcctcagtggcgataaagtatttaacacttatctgtctttgcagacaagcatgaaactaaattgaaaggagtaatatactttcaagccattgaagaagtctattatgatcacctcaagaatgctaataaggtaaacatcagttttctaaattcctacagtttgaatgcataattaagaagggaaaaatatttttggagtctaagaagtttgaaattgatgttctgatgtaacagatagatatgatcagaatggtgctggaaaagtaaacatgaagtaagtgggatggccgttctttttgaggaaaaaaaatatcatagcaaattgaggaaatattctggacataatggtttgggaaaccctgcgaaacgactctgccagggttctaaaaagaagctaccatatagttaagagggggatcgtgagcaagtcctagtagggctaagaataacagctactatttattaaactcctactctcagctaggtaccctgctagagctttacaaactagctgctgaaataatttatgagttctgtctgagatttcctgttcagaaaaatggtcaatcctgaaaaaggctctgggacaggtgtgtgagttatagtagagcaaaagtaacgcctttgtaaatttaataaattgaaaattttgaagaagtcatcacatgtctgtgttatttaatgttgtattttaagatgtttattttacattctttttccttttttgaattttagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttcttataaactgtttttaatcagttgtcggatttggtgaaataaactaaacaggttacagaatatctgtatgtacttggaaatacagaataactttatcacccacatcattggcattgacattattggtaatcaactggcttttttttaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatatatatatatatgtagtaaaccactttttgtaaaagaagaaagagcaaaaagctgtgcgttttagaaaaaaaagccatgttacacaacagacattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcgacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacatatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaaaaaaaaaaaaaaaaaaaaaaaaaaaaaaaaaaaaaaaaaaa

SEQ ID NO: 456 - DNA, 4135 bp, Homo sapiens
cacgagtacctcagcttccgagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggtaggcgggcagtggggttggtggcatgtgaagttcccctcaggcctcctcgtcagccaggacctgggctgctgtgggggacatgggaggggctgcttgagccagggccggctcggctccgtacccgccacaggcactcggccctgatgccctcgtgtccacttgtgtccacacaggccctgggaggagcggggacgctgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcctgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcggaaaaaaaaaaaaaaaaaaaaaaaaaaaaaaaaaaaaaaaaaaaaaaaaaaaaaaaaaaaaaaaaaaaaaa

SEQ ID NO: 457 - DNA, 3620 bp, Homo sapiens
gggaaaaggcatattcacaaggttacaataagtgagttttaggccttggccttcagggtcctggagtgtaaagactagaggaaaggagaccaagaaatcctaaccttacaacttagcaaaaaactgaatcttttttataagggtcagagctttagaaaatttttttaaacctaagctaaacaaagaatggcaaaagaaaatgccacttttatcgaagcctttatttttattacaactgattattttctgttagtgtagaaaactcagtaaaacaggatgtgttctagaaatattgtctaggagatataatcatgttttctgataaattgacagaaaaggaaaaattttgtatattattatagcattgtgtgcagtttgcagttagagccactatggatagtaattgtcattattcttagttgcttatcattttatttagaatttgtgagtttaagcttccattttaaggtaaaatcagttagtttgaacacacaataaataaggttaataaagcttatttattgatcatttctgtccacctacaatcattgccttttgcagggtgcctgtgagatataaaatttataactgccacatcctttcttaggaatttttaaatttctattttcttgtaatatgaatacaagaatacattcttgtaaatgaatgtattgaacattagttatggagtatttttcttagctacttgatattagatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaaggtactttttacaaatatgtacatttaatcccatttggggtgtgtagtgtgtgtgtatgggtttgtgtgtttatatgtattcatattcttatgggacatgaacccaaggttttctctggatggtggggaaaaaaatgaggtttttgttttttttttctttaatcttatatattttaatcatatgtataagataattttacagtaatatttttaaaacatatgctttttaaaaaatctcaaattgctgaaagttattaataatttgagaatctttacaaatatatgtacattaacaccattatgtttgcagccagtcaggcaagggatttgttatccaaaatgctggtaatagatgcatctaaaaggatctctgtagatgaagctctccaacacccgtacatcaatgtctggtatgatccttctgaagcagaagctgtaagttattttcttaatgtttacagaacatattgcattcttagagttagaatgacagttaggtttggaggagaccttttaattttaaataaaaatgtagatacatgatgatgatgtttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaagagctagaagaaaagaaaaaagacagttaaacattttatttcctgcaatgaaggagtcttcctaaactattatgtctgtataagtaagttgatgattgatcagtcttgatctaatgatatatttttataagtcatctgtgtggctaatatttcaaataactacagagttaaaatactcccagcatactgacttggttattattgccttgtgtttttcagccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttatttttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaaaaaaaaa

SEQ ID NO: 458 - DNA, 3804 bp, Homo sapiens
gaaaattgttcattcaattgtgtcatcctttgcagttggaatatttggagttttcctgatcttgttggatgtggctctgatctttgctgacctaattttcactgatagcaaagtttatattcctttggagtatcattctatttctctagctattgctttattttttctcatggatgttcttcttcgagtatttgtagaagggagacagcattatttttctgatttacttaacattttagatactgctgttactgtgattattctgctggttgatgtcgtttacattttttttgacgttaagtttcttaaggatattcccagatggacacgtttatttcgacttctacgacttatcattctgataagagtttttcatctggctcatctaaaaagacaacttggaaagctgataagaaggctggtttcaggaaacaaaaggtgatacgaaagtgatggatttgacctagacctcacttatattacagaacatattgtcgctatgtcgtttccatcttcgggaggccagtctttctatcggaatccaattaaggaagtcatacagtttctagacaaagaaacatccaaaccactatcgagtctacaatctatgcagtgaaagagcttatgatcctaagcacttccataatagggtcagtagaatcatgatcgatgatcataatgtccccactctacgggagatggtagcattctccaaggaagtgttggagtggatggctcaagattctgaaaacatcgtagtgattcactgtaaaggaggcaaaggaagaaccggaactatggtttgtgcctgcctgattgccagtgaaatatttttaactgcagaggaaagattgtactattttggagaacggcgaacagataaaaccaatggcactaaatatcagggagtagaaactccttctcagaatagatatgttggatattttgcacaagtgaaacatagctacaactggaatctccctccaagaaaaacactgtttataaaaagattcgttatttattcgattcatggtgttggaacaggcgatggatatgatctaaaagtccaaatagtaatgaagaaaaagattgtcttttcctgtacttccttaaagaattgtcgggtatttcatgacactgaaacagacagggtaataactgatgtgttcaactgtccacctctgtatgatgatgtgaaagtgcaagcttcctcttcagacaaaaaataatatccaaagatattttggcactaacagcgctatctgtagcaagaaagttgagcagtgtgaactgttgagacttccaagaagacttcagagaaccaagacagtgtaaaggaaaacaggaaaaaagacttgttagacattattaagggcacgaaagttgaattgagcacagtaaatgtacaaacaacaaagccacccaacagaagtccacttaaaagctacaactggcccgcctcaaagagctacagagcatgctccaaagaagagaaatgagcccgtgagtcctgagttggtggcagctgcatctgctgctctgttttgacaagcaaacaagccagaactgctcaggcagctccgtagcatgaggaagagtcaggggcacagagagatggagagagacctagttagagagcgaaccatgtgctggatttagccagtcctgcatttttctatacttcaaatcaaaacgggccatgcttcacatctacccatgatgaataggggtactttgattaagaataaatagagctgactgaattctgaacaagaaaaacatattcaaggggaagagatgtaatagttttgacgtgacgacagttactaaagaagcacctgaacagacacatcaccttcactttgggatgtggaatttgctaaataagccacagaaaatgaacatcccttcagaatgggtttgaagagctgatccagtggattaaagaggggaaactgggagtttccaattaacaatgaagcaggagctgactaaggctttggaacagaaaccagatgatgcacaatattattgtcaaagagcttattgtcacattcttcttgggagttactatggatctgtaaataactgacgaaaaacccatctgtttctacgtagttgctgttgccgacacaaagaagtcttatgaactcaatccaaataattccactgctatgctgagaaaagggggctggcggcatggagtcttgctctgtcacccatcctcgagtgcaatggcaccatcttagttcactgcagccttgaattccagggctcgagccatccttctgcctctgcctcctgagtaggtgggactacaggcatgtgccaccatactgagctaatttgttaaacacttttttttgtagagacgaggtcttgctacgtttcccagactggtctctgaactcccggcctcaagtgatcctactgccttggcctcccaaagtactggcataatagacatgagccactgcacctggctcctaagttcttttcttgaataatatctttctttttttttattttttgaggtggagtctcaccctgttgcccaggctggagtgcaatggcgtgatctcggctcactgcaacttctacctcccgggttcaagtgattctcctgcctcagcctcctgaatagctaggattacaggcgtgcgctaccacgcctggctaattttttgtgtctttagtagagatgcggtttcaccatgttggccaggcttgtctcgaactcttgacctcgtgatccacccgccttggcctcccaaagtgttgggattacaggcgtgagccaccacgcctggccaagtaatatcttaatatcatgccattgacatttatcctctaattatttcagaggtggccttcagaagaaggcctctttggtaaaattgctattgaggatatttcactgaaaaacaaatttatctttaaatttaaatccaggaaaaatttaaactttcaggcttctatttttatcagacagggtaaaaaatttataactcagaatattaccctttcccctctttgtgtgatggattgcttggttttagttactgattatttaaaataataagttattcaaatctaggattttgatacaatagttcttctctagaatatagtgtgtgtgtgagagtatatttaaaatttttattaaggcccatggggcagcctttgaggaaaccagaccttggggatcgccaggcaggattagtggcaggaattgagagaacagagccccacagagctcctcggggaccgtcccccagtcacaagagtatctcaaggaagtagtcttctcccacatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagcttaacacagctggggtctgctactcgcgttttgtagacttttgtgtaactatttgtaccgtaggacagaatgtgaggaggaagtaacacacacagaggaggatgtgtgtgtgtgcatgtgtttgaattcacaaggaagaaattatttatcttgagctttttcctttgttattcagtttttattggtttattactaataatgataataaaatgtaaacaagaaaaaaaaaaaaaaaaaaaaaaaag

SEQ ID NO: 459 - DNA, 3487 bp, Homo sapiens
gtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccagggtaagccggggcgggtccgaggtgctccccggggtactctgaaagccggggagggggcgggaccgagggcggaggcgggtcccagtcgccaggtgcgggactgctgcacctgtgactgggcgaggcttccttccctccgtaatcgcgaccacagcctagggacggaagggggttctgagcaacctgatagaagtgccaattatgagaagccctccgagcttggtcagagggttgaagatcagaaggacttccctaccaccgtggagcatcagtgggggtgtaagtgatcccagcccttctatttgcttcctctccagcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccgtgagttacacatatctatgaaatgggccctgtttcctggatcctctttctgatgtcttggttctagaccctgaccttccggctattagccaagtgcttttgatgatacccaggtttcagttccaggtgtctcacacagccatttccccagaagccactcaccaaagctaatgttcactttctctcacttttacacctagcctagttcctatttgcaaatctcatgatatagtctttcttttatttctccttcctggttagcaccttatttttctgatctcataaagtgtttttggagggaagtggaggggattgggattagaggtttgcttgctgatgaccctattattctctagccaatcaagaatgcacccccagggaaaaaatatgttcgatgcccctgtaactgtctccttatctgcaaagtgacatcccaacggattgcatgccctcgtccctactggtaagaggcataaggtggggaagggcctaagtggggaactggaaagtcaaaaaaggatgagcgtatacagagaatgtaaaggtgagagagcctagtgtttatttaggagaaaaggctttgaagcatgtgcctcaggaatgttatagctgtctttctcgtttctcaataaaaatattgagatgaaatgatgtcgtttcggagaatagagagccttggggactgggtgtgttatcctgaggtcggaggggaattggggacctgaagtttaaacagtgctctttctttctcaaggattcttgagggtatacagttgggggacagagtatcttaagtacagagaagtcgagtgacttaatagacagggagtgggggatgtggaacagggactgtgaagatttttaggattaaaaatttttcaaacacaagtttgaaaatacaagtctttttcttttgtatagcaaaagaatcatcaacctggggcctgtgcatcccggacctctgagtccagaaccccaacccatgggtgtcagggttatctgtggacattgcaagaatacttttctggtgaggaaggggtattgggaaggggaggggaaaggagactaagagtcatttcgagtatatttcttagagtaatggtaatgacccctgaaaggtctgtcctatgggaacatgttctgcatccccaccccaaggttctcattgagggagaccctgcttgtgctattatttttgttttctttctccatagtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgccgtgagtacccttgccccaacctctttcattctgcagcctcatctccataggctaagatttgggaaactgctaccctaaaaaaaagtggaagaaacttaggggactagtttgttttgttttaagatatggatgagctaaagtgcaaagtggctgatcaaacagactttattactactacaagagtgaaaaacagccttcctttctctgtaggatgaggataggacagtgaaattcttaatttaagagttgctatttttcaaacctggctcagttgtcagatattaagaaaaactgagatacagtgtgggatgggatgagtatgttacgcctaagggaaggaagctgatcagctctgcctttaagaaggtccctgagggtggctacatgtggataaggaacaaggactgaagcgtgagttattactgttcttagaactaataggaggtagtggagaccaacattaaccccatctttcttttcttctccctccttatcttcatcagtttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactctaaaaaaaaaaaaaaaaaaaaaaaaaaaaaaaaaaa

SEQ ID NO: 460 - DNA, 3905 bp, Homo sapiens
gcgacgtcagaggcgcgggtgttcgcctacgtcactggggcgctacggtgcctggagctgggcggtcttctcgtcagagtggggactggtgagagcgacctccccgccaggtcctgtgtgttgccggctgaagaagggtagctgaaaaattcagacccagcacagtgtttatgttggtcaaaaatagaaaactatggcgcggccgaggcgggaggacccttcaggccaagagcagcctagcaacatggcgcaaccccatctctgtagtcctacctcagccccccagctacttgaatccaaagattcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccacgctcctgggcttccaaagttggagaaagctgccaggctcaggtctgaaggccagaattctacagtaagtcctactgagtcaaggtgggagcagggtcggtggcttccgaggctctgcgggagaatccgtttcctggcggtagaggtggcctgcactcctcagcttgtgctgcccgtctcgaatgactggagtttcctgcttctgtcactacacctcccaccctctcccatcacctgctctgctcttacaaggatccgagtggagtcttgctctgtcatccaggctagcagtggcgtgatcttggctcgctgcaatgtctgcctcctgggttcagatgattctcctgcctcagcctcctgagtagctgggactgcaggcgcccgccaccatgccctgctgttttgtatttttgagaaatggaataatcgtatcgctgatctatgtaaacaaattgaagaattgtctgaaagaaaatatgacatgaacttatgaattcaacaggtgaagatttacaacttgataaatcagctttgtgagctcgagctgtaaaagccaaaggtccggtgatgatcccatacccttttttccagtctcatgttgaagatttttatgtagaaggccttcccaaaggaattttttttttttttttgagatggagttttcgctcttgtcgcccaggctggggtgcaatggcgcaaccttgctggtcactgcaacctctgcctcctgggttcgggagattctcctgccttagcctcccgggtcgctgggattgcgggtgcccgccaccacgcgaggctaatttttgtatttttggtggagatggggtttcaccatgttggccgggccggtctcgggctcctgacgtcaagtgatcttcccacctcgactcctgacatcaagtgatctttccgcctcggcctcccagagtgctgagattacagacgtgaacccatgcctggccaggaattttgtttttcaggaaggctttctactaatggaattcctggccttgagaggatgttactttcgaaggaaaggatttttttgttattaaaagagccacctaagctgaagattcccttgagaacaagtactgtcctgcggtttcatggcccttcttccatttgtggttcttgcgaagtggaatttaaatgacatcttatcaagatggataaaccctagtttcccagtgctggaatatagaaaatggatggacaagtaaatcccactcagcacccatagtccaggcatggggacctcaacacacctgagccccagacatcacctttcattctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacaggctggagtacagtggcacaacctctgctcactgcagcctccacctgccaggctcaagcaattctcctgcctcagcctcccgagtagctgggattacaggaagtgaccgcacaatgactcaagctaccacatactgttgattgtgaaatgccagttgaagcatatgtcctgcgagcttaggggtgctacaagttgaccactgcagcagtaaagatgactctgaagaatggcgtgggatggatcctttcgaatgcatttgagcagcggtctccaaccacagggccacagagctggagctggatctaccatgaaagacttctgaatccaggaagagagactgactgggcaacatgttattcaggaacaaaaagatttggactgtaacttaaaaatgatcaaataatagtgcatgcatcaagtgcaatgggaagctcttctggagagtgagagaagcttccagttaaggagatggggtctcaccctgtcacccaggcttgagtacagtagtgctatcacagctcactgcagccttgaactcctgggctaaggatcctcctacctgagcctcctgagtagctaggactggtctccctctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaatttttgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgtctcacagcagattcttcaggcccagcatctgcctcactgtggaccccccaagccaagctcccaacctttcagcagcttctacacacccagctcctgccacccagtggcttctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttggcctctccaggcccagctcctgcctcctgtcagcgtctagaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccagaccccacccccagatgcatttattagaaataataaagttctttcttagctaaaaaaaaaaaaaaaaaaaaa

SEQ ID NO: 461 - DNA, 2053 bp, Homo sapiens
ccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggaatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgcctttgcttggagtctgtgatccatctgatgctgcccccacccccacagtcctattttcccagctaaagaccaggagagtctccggctggctcccaactggggctttgcatttctctagagttcatctctgagctgtaagggtgaccagggggcagggggacgattgtgtatcagctaggctgcttttggctgcaagtaacaaaatatcagatacaaataggcttaaacattaaagagatttgattagttctttaaaaaaaaaaaaaaaaagg

SEQ ID NO: 462 - DNA, 2457 bp, Homo sapiens
tgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 463 - DNA, 3097 bp, Homo sapiens
agactatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatctgaattttgaaaaaccacaaagctacaaactgaccctctttttttttttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtctttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaaaaaaaaaaaagaaaaaaaaaaaaaaaaa

SEQ ID NO: 464 - DNA, 1044 bp, Homo sapiens
gggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccagaaaaaaaaaaaaaaaaaaaaa

SEQ ID NO: 465 - DNA, 1041 bp, Homo sapiens
cggacgcgtgggctaaaggatacatcatatactgacaaactcaatgtggtcctttcaagaattagccatgagtctcaaaaaggcaataaatggctctaagtggacaggtttgcttcaaacaagtaacatctacattttgtctttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaagaaaaaaaaaaaaaaaaaa

SEQ ID NO: 466 - DNA, 2757 bp, Homo sapiens
gaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcttgttatgatacggtcaataaaaccacttttataggaagaatactcacaaaaaaaaaa

SEQ ID NO: 467 - DNA, 1458 bp, Homo sapiens
attttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaagcttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagcccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcaagcttccgataggacctgcccagatttctgcatgtgcacttttgtttactgaaagagagaaaggggggggtcacagcaacatgccctggcctttctgccctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggcgttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaaaaaaaaa

SEQ ID NO: 468 - DNA, 1896 bp, Homo sapiens
gaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtttcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatcctttaaaaaaaaaaaaaaaaaaa

SEQ ID NO: 469 - DNA, 1444 bp, Homo sapiens
cggacgcgtgggatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaaaaaaaaaaaaaaaaaaaaaaaaaaaaaaaaaaaaaaaaaaaaaaaaaaa

SEQ ID NO: 470 - DNA, 2352 bp, Homo sapiens
ccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggaaaaaaaaaaaaaaaa

SEQ ID NO: 471 - DNA, 4926 bp, Homo sapiens
cggagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggctaaagcccctggggtaacagtccccaccgctacccgaggtaaaacaataaaagctatgtggttgagctcaggcctctcgtgcctggtgtcagagaaggcagagcccacagtaggtgcagggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggagagcctgtatggccctgtagccctgggcagagctgggcctgtcgtgtgttcctgcctggcaggtgcaggtgctggccatctgcaggtggaaggaggtgggaatcttggattttttgtttttttttgtcttttttttttgagatgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcgtgagccagtgcacccggcggaatcttggaatttttatagacggcacctcagtttctgactccagccgcacacctcctgcctctaccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcagataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcactttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgccgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggtaaaaaaaaaaaaaaaaaaa

SEQ ID NO: 472 - DNA, 2620 bp, Homo sapiens
ccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctaccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcatctagggagaggggtcccccatggtggctcccctccctggccattgttatcccaggaggagacactgtgggcacagggctaagtccaggtgtttgtattcgggctagaaaaggcaatgtcccaagtctctgctgcctgtcacagtccttcagccagggctggacctcaaccctgaggagtcacactgagttccagtgaccaccgtggtggtggccatgccactcatggttgctatggccggaaggcctggggcagcctcctccaagccgctcgcaccccgtaggtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagagtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttctcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcggcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataatttcaaacattaaaaaaaaaaaaaaaaaaa

SEQ ID NO: 473 - DNA, 3104 bp, Homo sapiens
caagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagcagggcccaatagccccaccctgtgcctttcagtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccgggctgacctcagctcccgaaggctcgcacagcctccccatccttccttcccggcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccgctcctccccacggtactgtgaacgtcgtgtgactcagtgcagagacagataatatatttaattcatgtaaaaaaaaaaaaaaaaaaaa

SEQ ID NO: 474 - DNA, 4542 bp, Homo sapiens
gttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgcttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttgtagcactctgaatatggaacttccttttaaaaatgtaattctacccttcacctttcctacattgtatgtttctgtgagattttactcattacaagtgaaagtagaggactgcctgtgaattgtttacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatgaaaaaaaaaaaaaaaaagaaaaaa

SEQ ID NO: 475 - DNA, 1503 bp, Homo sapiens
ggggctccactttctttccctctccgttttggtgggctggttggagatgaaatccactgaggagggaagtccagcaccctgtgtgccagtcctgaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggagctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaacttcaaaaaaaaaaaaaaaaaaaac

SEQ ID NO: 476 - DNA, 1758 bp, Homo sapiens
cgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggggagtggggagggaccgaatgcggggacagcgcggggtggagaggagagaaaaagcaaaaagaggaacaataacaaaagaagaaaatataaaaaacagaaaaaaaaaacacaaaacccctagaacacacaaaaaaatccagaaaaaaaacctgaaataaaagcccgagaattgtcttccaagggggggtgggaggggaagaggaggggggcggatgaggacgtctgattctcgctgagacagggctcggcacgcgttgaaagccccggtgcccaggtcttccctttcgcgggcttcagttcatccctcaagggattgggacccaggcgtccacgtacagggactggaggaagattagggacgcgggattataacatgggggttcattcctaccccccatcacctcccttcccctgactccccaccaagattttgcagagagaaatggcttttgtaccaggtcattctttataattaaactcacagtatctaaaaaaaaaaaaaaaaaaa

SEQ ID NO: 477 - DNA, 3325 bp, Homo sapiens
aattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatacttttgtttacccctctctgagacaggttttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcaggaaaatcagtttcatcattttagttacactaaacacttttggcagcttaatatgacctttttaaattttttttattttttttatttttatttctttaagatggagtcttgctctgttgcccgggctggagtacaatggcatgatctcagctcactgcaacctccacctcctgggttcaagcatttctcctgcctcagcctcccaagtagctgggattacaggcagcaccacacctggctaattttcatatttttagtagagatggggtttcaacatattggccaggctggtctcaaactcctgacctcaagtgatccgccctccccagcctcccaaagtgctgggattacaggtgtgagccaccacagccagccagtatgacctatcttaatcatcagctcaactgtaatttaaatttggctgttctctggagctaaaccattagggaagttcaaaggaatgtgccatgatttccgaatttgcacaagagaatgttttaagcattggtagcatcattgaataaaagaatagtttcctgatgtcactattttgaagtggaaattatcacttggatgtggaggttttactttttaaaaacattcagcttaattaccttaccttaattaccttagttagatatactaatggaaaaaaaccaagtcctttctctagaacttgttttctatttttgttccttttcatgaaaacttctcaatttaattttaactactgtaggatagtattgattgaatggatactatggaaaagtggatccaatatttaagatagaagtagtttaaggagacaacagcctttactgccatttttttttaaatgttttcactcagatgaacaatttgactttaataaaagactggagatttttgtacaaagaaataggaataagtttcatatactaattatgctgagttttaagcctacatatcacaaaatatttagaattgtataaccttttcatatatttataacttttaatgtctttttaaaagatgtgggaccaaaaatatatttataatttggaaatgtgactgcataccaataagaaaacttaccttattttgaaatttatctgggatattaaagaatctaccaattcttaaaaacacagatttatactttaagcttattttaaaattaaagaatatataccaattcttagaaacactttaaggactactcttaaataacttaaatatcagagttttgttgtaatattaaaatttaccatggaaatcactgttgttcagctatcaccttaattgtgtatgatatgataaatgtttagcagtaaagctatcttaagatttaatggaaaagtttaatttgaagatgtaacaaaaattctgaccacagttgattctgaatttttaaggctttcctaataggctgatcacagagaataatccattttgaaggtataaaactgcactgtatgtctgtcacttgtagctgaactgattcacattttgacaaaagagagaaaatacaaaaatgagttttgcaaatgtaataactttttctgcatatagaactaaataattgaaaaatatgggctatagttctcaaaggtagatagtaaaatcactggctttttccagctgtatgtttttccactgtgcgtgtacacacacactggaaaataattaggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtggtgagggcactaatcttgtaggaaacacttacttgatgttttatttgaacttttcctataggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatgggatgggaaatatttaaattctaggtgttttttttttttttaaagaagaaactcaatgtttataagaaaaaaatgaataaatagttacgtttggccctgaaaaaaaaaa

SEQ ID NO: 478 - DNA, 2368 bp, Homo sapiens
gataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttagcccccaaggttggggcccgacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcc

SEQ ID NO: 479 - DNA, 1810 bp, Homo sapiens
cccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggggcgggcacaggccggagctgctccgagagctacagcggctgcacgtgacccacacggtgcgcaagctgcacgttggagattttgtgtgggtggcccaggagaccaatcctagagacccagcaaaccctggggagttggtactggatcacattgtggagcgcaagcgactggatgacctttgcagcagcatcatcgacggccgcttccgggagcagaaggtaattttgctggctttgccaggcttccctgcctgctccgaagccccgttttcagcccagagcaatccaggggcacttctggcagcctccttgaggcagagccctttggaatccagccacacccaccctgtggctgctccaggatcagacccccacaggcccatccaggcgcacagtaggaagccagttccggctgaagcgctgtggtctggagcgccgggtatacctggtggaagagcatggttccgtccacaacctcagccttcctgagagcacactgctgcaggctgtcaccaacactcaggtcattgatggcttttttgtgaagcgcacagcagacattaaggagtcagccgcctacctggccctcttgacgcggggcctgcagagactctaccaggtgagcagaggcccctttcccagtgtcgggacagagcccacaaggaattcaccttgcctgggccctgtgcatccccaaaagaagcaaggtgggtgagatccccatttctcaggctggccccccaaggctgaggactgggcaggggctggctggagttgttccttcgagctccagcctggcctcagtcccttcttccctcagggccacaccctacgcagccgcccctggggaacccctgggaaccctgaatcaggggccatgacctctccaaaccctctctgctcactcctcaccttcagtgacttcaacgcaggagccatcaagaataaggcccagtcggtgcgagaagtgtttgcccggcagctgatgcaggtgcgcggagtgagtggggagaaggcagcagccctggtggatcgatacagcacccctgccagcctcctggccgcctatgatgcctgtgccacccccaaggaacaagagacactgctgagcaccattaagtgtgggcgtctacagaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaaaaaaaaaaaaaaa

SEQ ID NO: 480 - DNA, 3141 bp, Homo sapiens
caactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagtcctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaatagaaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgctggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagcgagctggtcctgggcctggcaggcaagagtgtgggcatcctttcctggcctttctccactctccctcaagcctgtgctcaggttgccttgaatgtggactctggaagagccaggggcccagaatgccgggggaggcttctgggtggcactcatggaacaccgtccctctgccagccataggccctgcctccagtgtcagggaatggaggctgggctgcgagagtgttgctgccccctgtgtcgttcttctaatccaatgtagaaattgtacgtaatgtatttaaatcaacgcaaatgtatgaataacaaatacaaaaaaaaaaaaaaaaaaaaaaaaaaaaaaaaaaaaaaaaaaaaaaaaaaaaaaaaaaa

SEQ ID NO: 481 - DNA, 1383 bp, Homo sapiens
gctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacgaaaaaaaaaaaaaaaaaaag

SEQ ID NO: 482 - DNA, 1715 bp, Homo sapiens
aggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaaaaaaaaaaaaaaaa

SEQ ID NO: 483 - DNA, 303 bp, Homo sapiens
tgtaaaaaaaaaaaaataagaaaaataaaaaattaatttttgtagtgataggatccccctgaggccagagaatagggtttggagacaaaggagcattcccttcagcctttgactggtggcaggccaagtctttatttacatagggtgtaaccaaataggaaacctttaaaggggacttaaaccccagattttttacacagggcacttgcttgagcctcatcccgctttttggaatggcttttgcttcaataaatctgggcttttgttccttccaaaaaaaaaaaaaaaaaaaaaaaaaaaaaa

SEQ ID NO: 484 - DNA, 495 bp, Homo sapiens
agagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcaa

SEQ ID NO: 485 - DNA, 414 bp, Homo sapiens
tcgcagctcagcaggtctgggttatgacactaaggaattcttaccgctctttggagtggggtctggcataagggtctagacaaggacccagggttatttctcagaaatgccctggaagcccctagtaattgagaccttacagcaatcctatgagccattacaaaatggaagtgcaattaaaaatggttttgttttttagggagaaaacctgaataaggaaaaatgttatttgacttatactctggactcctccattctgaatgtagactgcctagatttacaaaaccaaattatgagaaatcagaaatgctgcccatccttttaactctgctcttggttatctgaaagggtccgaagatggaatgactaaaatctgaaaaaaaaaaaaaaaaagtcgacgcggccgcgaattta

SEQ ID NO: 486 - DNA, 488 bp, Homo sapiens
tcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaa

SEQ ID NO: 487 - DNA, 518 bp, Homo sapiens
  misc_feature 18: n = A, T, C or G
tcttcacatggtcatcanagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaa

SEQ ID NO: 488 - DNA, 534 bp, Homo sapiens
atgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttcaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaa

SEQ ID NO: 489 - DNA, 425 bp, Homo sapiens
actactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtggtaagagaccaagagagtaaattttgaatacattttcaggagtcactaagtgcaaataaaaattttatattgaccacttc

SEQ ID NO: 490 - DNA, 844 bp, Homo sapiens
agaaaatgaggaggagttggttttactcttagagataagacttcagcaggggctcagaaaccccaaactctagttaaattgcttctcggaggaaaatcttaatctagacagattcagattcccaggctctcctggaagccctgcacttcagggcacaggggccctgggacgtggttggcagccaggctgcgagagagctaaaaaggaacaagaacatcagctcggatgtttgtctctcagccctgacacctgccactctccttcccggggcacttggccctatcagagggacatgaaatgctgtccaaatggtggcagaaatgcagcgacattgcatgcagcagagtctttgcttcgaaagatggggcgccatgtttcagagaacatttatcttagtcccacgttcaggtgagaagacctcaaaggtaccctctgtccagaataaacattggaacaatctctcaattggcttttgtcactacacataatgtaatctcccttctttcagctcccccaacagtgagcatgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtatacatatcaagatttctatcataatgataatgagattgatgacttcttgttttcctccaataaagacaattaatcaccttc

SEQ ID NO: 491 - DNA, 445 bp, Homo sapiens
  misc_feature 74: n = A, T, C or G
tgaccctgctcgcttcatcgtggtgcccgcggcctatgccttggcactgggcctggggctgccagccaacgtgncggccctggcaatgttcatccgcagcggcgggcgcctgggccaggccctgcttctctacctgttcaacctggctctggttgatgagttcttcacgctcacgctgcagctgtggctcacctactacctgggcctggcccggaggccgcctgccacgcggccggggccacctactacgtgtccacctatgcggcggtggtcttcgccgcgctcatcagcgtgtgccgctgcggcttcgtacgcggtcccgggcccagggcggctgcccgcctggcccggtgcctacggcgccccgcgcgcgctgcctgcgccttcgcctggctggcgggcctggcccctccctgcctgaagcaccgctgggcaagctcggggc

SEQ ID NO: 492 - DNA, 854 bp, Homo sapiens
gatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagct

SEQ ID NO: 493 - DNA, 353 bp, Homo sapiens
aaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagc

SEQ ID NO: 494 - DNA, 495 bp, Homo sapiens
tgggaggtgaacgtctttgtggctatgtgagcagcatggaattgtctacgccttttgattggaatgcactcccccttggtgaaagggaatctatgtcttttttctacatgcagttatataacacttagaatcaccattctttcccataaggcttgtacataagccctaccttttgtccctaaggaaggagttggtgaaagtcggcctgtgagtaacattggaattaggcagtagaatttgaagaaatggtagcaacagacagccctctgctcccttaagtctttctttgcctgattattgaatttgtagtagatcaagggggatgccatgcagagaaagaccatcaatcctgggttttaggttcagggtcagttaccagcctcaggatcccggtcagttccgtgctctgtaaaaccgatacctgctttacctaccttccaaggttattttgaaaaggaagtaagattatgcatgtaataaatatcttatgaaagt

SEQ ID NO: 495 - DNA, 370 bp, Homo sapiens
cctgggctcaaattccagctcaactacatagcagccttgtgaacttcacctctgcctcagcatcctcatctataaaattggtgatagtggcagagatttcacaggcttgttgggaggattaaaggaaatattacctactatggagcttctcgaagggaagcaattttgactttgtttttacttctttgttcaaactctcacttcagtcccaaaatgattgagttggcagcttagatattattacagttgtttgccctacttcatgtcttttttaaacattggagcatctgaaacttcactttggaaaaagggaagcagagtaggtatttttggcacaatgacctctatcctatgtggggtttgtttaaac

SEQ ID NO: 496 - DNA, 372 bp, Homo sapiens
aaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaatt

SEQ ID NO: 497 - DNA, 395 bp, Homo sapiens
actcaaatactggtgagaggtggatttgaagccaggagccccaggttttggctctgcaggtttgcacccagctctgtggtgtatgccctcacaggtcacccaggacctcctgtccaggcttcttcaggccacccatgatggagtagatttgaggaatgaggttttcaaagcagttagtgtgcgggagagtaaccctggggcctccggaaccagaagggagggatttgggggctggagcttggcagtccaggttccattgtcctcatgttctccccactggcctggcctgtcactccagtctctgcataggttgtcacatggcattctccctgtgtgtctctgtgtctcttctcttctttataaagacatagttataatggattagggcccaccct

SEQ ID NO: 498 - DNA, 606 bp, Homo sapiens
cagactgacagccaggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgctg

SEQ ID NO: 499 - DNA, 499 bp, Homo sapiens
cagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaa

SEQ ID NO: 500 - DNA, 364 bp, Homo sapiens
ctactcggccagcacaagatggcagccagagagctggggccgctcgtccaatttgtgcaactgtcccccaaagcagcgaagccaaggggctactttggccccaccccggacacctcagccagcctcagtgacaggagctgctcacaacaggtctggcgggtggggctcagacaggcctcctgtgcaaactgctggcccccagcttccagttaccccatggcccgccttctggggggtaagtatggccttgggggccaggcaggacaggtccacggggcctgtgtccccactgccccaaaataacagtgtgttttttctttcagcctcctaaccattttttttttcatttttcatctttttttct

SEQ ID NO: 501 - DNA, 591 bp, Homo sapiens
agaaaatgcttctatttttctttagcacctccatggttctcatatacccatgtctgtaaaaagtgacatgagaattttgttgggttacattttattgtatttattagattcgcttatatagatgacttaggcagaaataaagtcatgtctttagaaggtgaacaagccaacttgtgatggcctgccttttgcttttggcagttgggatgagaacaattgactctcccattggttgttagatagttgaaatggtgcgttggtggtcatacttagtgttctaggctgtgaaatcatggagttcttccacttccaagaatgactcatttgctgttggattctagtacagaatttagcagcctgatgtgtccccaaactgatttaatttctactgaagtgcccttgtgtacatttgttttgtaatttaccaaagtactacctgagtgtataatgactcctgcagtgagttaatgtaattgctgctttgaccattgttttaaatctgtgtactagagtaactgtgagcagaatgaaatcacattatctcagtgttcaaaatatcattctaataaagtacatgcattaaacaatttt

SEQ ID NO: 502 - DNA, 397 bp, Homo sapiens
gtgtggttctcacactgtggtgtgctccggaatcaccaaggggaggtaattaatatgtgattcctagtccccatacccagaactctggaatcagaatctctaggggtggtgcccagaccctatattttaaacatgccccgagggatcatgatcttgccaaagtttgaatatcaccatcttaggccatttcttgatggtttctacaggagagagtccggaacgctgtccttccaaggcaaggcctcaggctcattcagatcaggcctggccactcctctttggagggcggttgaggcccacctgccttgggcttcccaatcctgattcccccactacacccttcccagttctattcccctcaccacacttgctccaataaaactatttatatacagat

SEQ ID NO: 503 - DNA, 381 bp, Homo sapiens
caaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgact

SEQ ID NO: 504 - DNA, 365 bp, Homo sapiens
gggactttagatgcggctttgggagaatggcaaaaggggactgcccccccttctcgtatcgtatcaacatcctactggcactaccttcagcatggtctgatgagatcagcaaggccagatctcacctaggctttcaccctatccctctttcatgatccttaggtgagaagtagagaacattcaaggccttccttccactaagataggaactgtggctaagacagaagaaagaaggtcagatgtttgaatggactttctggatttgataaaatgtgacactagtggtaagctcaaaaatggaacttatttccacaatgagtatctatttccttttagtcagaaaagtaaagcatgttttaaaaagt

SEQ ID NO: 505 - DNA, 505 bp, Homo sapiens
cgaatttgttgaagaggtgggtgttcagtatcgaaagagccgcggattgtacattagaaagcctggctttgcgccgcgtccttgccacttgctgaccaggcccctccacgtggtccccgccggggcagcagctctcctcacccgtccaaaggcacggggaggcgcgtggcggccccgccagagctgagccccctgggatgtgaggccgtctcgctctgagcttcagagcagggttgcaggagacacctcagaaggtcgttttgaggacgggaggagatgaactgctcaaagcctgcttaactagataaatggtatcgattaacttttttttgactccctttccacacctataaaatgaagatgacgggaaacttgtcatactttttttgtggtgggtgggaaaggtctttatgaactgtgaagtcctatgcaaacgtgagatgttaccattcgcaatctgattagcgaagcaaaaacacgcgagtcaaaaacatacacagaaagc

SEQ ID NO: 506 - DNA, 416 bp, Homo sapiens
atatgtcaattatatttatgcatccttcttatttgatttatatattttttaaatcttagacctttattgtttctagtggcccactaaagtaagtcaggggcagaggttaacaactgaatttgctcttcagtaatattatataacaacctgagagccctaaatgaattcttatgattctcctaagtacctgctacttaatataaaaagataacttcacccaggacacttggatttatatttctcccttgaacatcatcatatatcaaggacaaggtgagattgttcttattgggcaggaaagaaaaaaactacctccataaagtgttccattttctttcttaatattaaatctaataactaggaaatgttgggcagatagaatgaaagtcgaagagttaagggcattgagaacacac

SEQ ID NO: 507 - DNA, 347 bp, Homo sapiens
aactgcccatgctcaccctggcactgaccagccccaccccctccccagcagccagagaagcagtggcccggggcagttccgagggcagtgcctgcagtcaagtggccgggtcaggcgtggtgatctcttcttgcctcgtgatgtcagggttagggagctgccagtttcagaacaagctgtgctggacaggttacctcctgagtggagtcattaacttccccacgtctcaactgaaaggggcctgagtgatatagagaaagtggagaggggtttctcgttgtgatcattttacctttcttacagctaactccaccactaagtcaattaaaacaatccatccttaaagc

SEQ ID NO: 508 - DNA, 409 bp, Homo sapiens
ggccttaaaatttgggggacactatattaattaaactttccttcaactcttgtttgaagacgtgtccctaaacccctagtttatattaactggttctccctgcaccagttgagggaccacccagtcaagaaagacacctgttcagatggtgtcattcttcactttggccagcctatacagcaatagaagaggcctatgagctattccctcactgacaccctgctatcccctttataatgtagatctcaaaaacaaccaaaccgattccagctactttattacttgacttatagtaagtggcagagtaaccttatgttttgaatatatgtgtaataatagtatcttttatgttttttcagagaagactattcaaggacctcaagtaattaaaacatataggccttaaacc

SEQ ID NO: 509 - DNA, 865 bp, Homo sapiens
ctatggaaacagcatcaaagagaaaggaatgtggggggtttccgctgccccccacccccagcggcccaccccatgcctcagcttcatgtctgtcccattcctataccatccccaccctgttgtatgtattataggatttgtattttctcctttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgtttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccat

SEQ ID NO: 510 - DNA, 700 bp, Homo sapiens
gaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttg

SEQ ID NO: 511 - DNA, 1043 bp, Homo sapiens
  misc_feature 439, 526: n = A, T, C or G
attccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtggataattcatgtaatctctaactgtggggcaagtatttaccctcangtagtcaagattacgttagagacttcgtccacgaatccacaccacctttcccatcagttctcaccggaaatatgctgccaaaaaganaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgacgggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatc

SEQ ID NO: 512 - DNA, 394 bp, Homo sapiens
atagcaagtctccatcctctgcagttagctcttctagttataacattgaaataactagtagttatagagcaatgtctgttggcaggcattgtgccatgaacttttatacactatttcatcttaatcctcacagtcctggggcatactacgtataggtagtatcttcatcgttagtttacgatgatgaggagactgaaactgtgtggttaggcacctgatagaaggacacagagctggaattcaagctaggtccacctgagtccagagcttgagctataagctgtcatgctctactgactgccttgatgtttattggctagaagtcattaagtgtgcctgccatcttatgatttggactggtgagcaggttgttaatattggttagttaaaaagg

SEQ ID NO: 513 - DNA, 431 bp, Homo sapiens
cttttatgtagaacccagtgcaccccatttttgagaagtgcctggaatgtggagttgcatgcttgcaactagagttaaacagagaaaaagtagttccggaaggagagcaactgacccttaactcgacctcaggggcctttaggcactcagaactgaaacttggatagtttgtaagggataagcttgtccattcatagttatatgtacaaataaaaagagcctcagtgaagttagttacctataatgtgggagttaaggatgggtttataacacaatatgtatttaatgtatttgttcaatgaaaagaaaaaaatgttacctagttgttggcctgatgaacattggcattttataatgcacaaattgtcccaaaccagttggtatttaattacatttgtttggtttctgcataataaacaagtcttccgatt

SEQ ID NO: 514 - DNA, 466 bp, Homo sapiens
gatttgctcacagaatgccaggaaggctcagaaatgagagttccccagttccccagaggcataggtgaagcagaggctttaggatgggagtaggggtgggaaagtctgcaggaggtaaaggggagccccagaaggacttgagaagggaagttccctattgcagctctggcccaaggagaagagcccatctagaatagagctgaaggaggagggctccaggaggagtgtttctgggaggagcaggaatgaaactgattagaaaagaagaaaaaaagaatgggccgtactgggtttgaattctttctctgtcaccaatgaactgtgagtatgaggaaattagttaatgtctttggacttttcatttccttatttattaaataaaacattatatcatatggtattttgttattctgttgggtaaaagacagtacaaaacccagcaagtctacttccagatgtctacccc

SEQ ID NO: 515 - DNA, 430 bp, Homo sapiens
gaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatg

SEQ ID NO: 516 - DNA, 407 bp, Homo sapiens
aagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtcctttttttt

SEQ ID NO: 517 - DNA, 400 bp, Homo sapiens
ctgcctgcatggctggagcgtagcacttttgaaagcccttcctcaaggcacccccactttccttggggttaccacctcactcgccccagaacatctgggtctgtaaccagagactggacctggaatcaggactcttggctcaaaagggatttaactccccgggcctcagcttcttcatctgcacagtggatggtcagcctttccttttattgtcattgtggtgattctattatagtaattaccttaaaataaagaaatccaagacaaaacctgcctcacctaaacaacctcttctttcatcaaatccatgttgtcatgtgtccacaggactgtctactccttgcctatttgcatattcagtttctacctgtttgcagtcataaactagtttcatgcactg

SEQ ID NO: 518 - DNA, 554 bp, Homo sapiens
aggaggatcacctgagcccaggaagttgagactgcagtgagctgagattgcaccactgcactccagcctcagtgacagcgagactgtctcaaaaaaagaaaaaagtgactgaggaggaagaggccaggtggaaatggaacagaatcaccaaagggtgaacaggactaaggcaatgtagtgtatggctcagctacgtcagagtggaaaaggtgttattagagcagaaactatggtccctgcgtcacagggaagcaacctacagagaagcagcagctccccaagagaggagagataagaagccagaagcctcagagtgaacaattgtcctattagggattgctctagagagagaaacctctgggaacgtaaccctgtgaggcagcacagcacaatgcttttagaattgtatgagagttgatatatctccatttgttttgcaaaggcaaaaactaagatacagagattatctgttaaagttatgtatttctttggtaataaagatgctgacagtgttgctggaatgcatttctttaataaagataattgtacaatga

SEQ ID NO: 519 - DNA, 872 bp, Homo sapiens
aactgtccccgccttctcccgccttgacttgtgaccctaggccctttgcggcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctccaa

SEQ ID NO: 520 - DNA, 416 bp, Homo sapiens
tgaaacacctatgtataagcccaagcctttcattaatattaactgtgagacccctggaagctactactttgtgtgagcctgttttctccgccctcaaacagtggatataatacccccttgcaaggctgtgagattaaatggataactgtgcataatgctaagcatggtgtctgggacgtaagaggttccttatatcccattagttcactaggtgggatcaccaagttgaaattcattttttaatattttgcttgttggagtactcacaactcaacttctctggctaatttgatgtttaatttgaaaggtaatgacactattttgtaacatttttagatgcttaagggaaatttgaaatgcaaagtggaacaacattaaaaggaaactcatttgtaaaataaagaaaaacaaaatct

SEQ ID NO: 521 - DNA, 370 bp, Homo sapiens
tgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagt

SEQ ID NO: 522 - DNA, 398 bp, Homo sapiens
gctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccat

SEQ ID NO: 523 - DNA, 1262 bp, Homo sapiens
gtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgt

SEQ ID NO: 524 - DNA, 368 bp, Homo sapiens
atgacccattcatcacacaggtgacatacaggccgagcacttcacttcctgcaggtttacagcaagaacagaatcccatgagataatgtaagggggaaaggcgtcctggcctgaatgtctcctcccctcagccatagggattggctctgggagagacacgtgagccaagcacggccaatcagagtgggccctggacattttgctgcaatttctgacggaaacagatgggtggtaaggcagggggactgctgaggacttctttgccacctgagggtgagcagaggtggggcaggaggaaggggccgagaattaagttaaacctgagaaaggcagagtctggaaataaagaggggtaaattcctgatgag

SEQ ID NO: 525 - DNA, 429 bp, Homo sapiens
tagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactat

SEQ ID NO: 526 - DNA, 640 bp, Homo sapiens
ctgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgattttttttttttttttacacaattctctgtagactaggagaagaatgcttgtgtttttcggaagtgtgatgcttctctttgactgccaaactcttttatggaatatatctttatatta

SEQ ID NO: 527 - DNA, 383 bp, Homo sapiens
tgaattaaatccatttgactgctaaggaaattgaaactcaaagagatcaagtgattgatttaaggctccactttccagtagggactcacatctgatttttcccattccagactgactctgatataatatcttacatactatttgttactctttctccaagatcttagaaaggtcttttgattctctaagaaaagataataggacaatgcaaatgcgtggatacaccatcaaaggggtggctgagggctgtctacctctttgtatagttctttcctaggttcctgactccgctaaaaactcatatccttaaagatatgactatttagatacattccttgttggagataagaacacaagttcattgctgaatcatggtgtatata

SEQ ID NO: 528 - DNA, 845 bp, Homo sapiens
cctaccacccagacacccaaacagccgtggcccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgttt

SEQ ID NO: 529 - DNA, 604 bp, Homo sapiens
tctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagata

SEQ ID NO: 530 - DNA, 388 bp, Homo sapiens
gcctttggaagccagatctgtgatcccaagccgcctcctccaccgactgtacttcatcaaccttctctcatgtttttccgacactcctgggtcagactcctgggttcatgacttacttgctagcgtcccttcattttcccacaagtttgccccccacctccacttacctgtctgccctcagcttcttcctgggagagagcccccctttcacgtagacacacctggctgccttcttcacgccctgaggacacttcttggagatttcagacaggcagcaccagggctcctgactgaaaggggagttggtgggcctttaggtctgccccatcccctggaaaacttaggacttattgggttattattatttttaattaaagctggtttaatt

SEQ ID NO: 531 - DNA, 1323 bp, Homo sapiens
tcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgcgggcaggaggacgagggtggctgtggacacacagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggactttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaaatagcattttttttttttccaaactactttttgtcactgtgacagttgtaaataaagtttgaaaatgcta

SEQ ID NO: 532 - DNA, 359 bp, Homo sapiens
acttactttgagcaagggtggctgacccaaaaccatgaggtggcagtcagctggatgacagatgaacacttcccccataactatttagggtagtacccaagcactacaggaaagggtggcaggaactgcctcactcctaggaactggtagatggtgaggttgagggtgtccagcgcccttaggtcattttctcactgcctgggaacctcaccaaaatacttcttgcttccttggggtcagcccaaagctgtcacaaaatcagatatttccctttattccagatttcctggacactttcacccaattataaacaccccacttcagccccaatcacgtgggaggaagtgtaacttcccttt

SEQ ID NO: 533 - DNA, 386 bp, Homo sapiens
gaagcaacacagcgcagcgtgactacgtgcttgatctgtctcctcctaatgggcatgcagaaccccagcttttaagttggtctccgcagaggacaactgcattctccagcctcctgtacagcagagagtgccatgtgactaagaccaagttctaaccagtgggatcaaagcagggaagtgttgccttctttgccccttcctgctggctggaatatgacaaaacggctgcagcatgagcaaccttcttgggccctgaggtggaagccacctgttggttgaccgaccagatggtggagtgaccagatagaaggggcctggtgattgtggattctgccacactacctctggtcccctatacctatgtgaaaggaaaagaaatgtctgcc

SEQ ID NO: 534 - DNA, 1760 bp, Homo sapiens
taaaaactataacaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcagatgaagtgatgactttttccatattctgtgtacccttgagcatgttgtgtctttttaaaaaacaaaaaaaagaacaagaattattttttaaaatgtaaatatttattacgatcagacttggaaaatggaaagtattttattgtcatgattgactttagattgttacctgtattttgttcaggtttgagacatataaaagaccccacctgtaatagaaaggaatatagacccttgcctcacctgtattgctgtggatgtgttttgtgggaatttcattcgattttacaaaacccggataggcacttccagttgtatttagtaggcagttgttgtgaatcatttttttctcttataggaggagattcctctctagccatgtttctgttaaagtttcattaattgaagcccaagtttactttttactgtacatacttattttctaattggatttgaaatcagcatgattttctttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgctagttggagcagtcaaagtcttagctatcaagagttgtgaatttgaatcatggcactaggtcaggggtgctatggattgaaatgaccttagttctcaaggagtgatttgtcctcatttgtcaaatgaggaatgagacacttaccatcatctcaggttgtttcttaaagacctaaatacaaatacaatttgttaaaaacttacagagggcctattttgaatgctttaagatgtaggccaagtaatgtatttttctcttagtgtagaaagttaagagaaaaagagctggtaccataaatttttttcaatcttagtgtaaaatctgtatctcattgtaggcttctggtcaatacctatacataacaacttaatgtgatctaaccaactcaactgatagaaagctgaattgttcccagtggacaagtggtatttgatgtttagcaggtttttttgttgttatttttttggtaaactctgtggtaaaatctaaaataatgttaaaaccctaaaagtaactattgaatattctgtaatcttagacatgtatttttcaagctaaccctttgaagaaatgtgttcaaggtaggaaaatataaaattttttggttatttgtaaatttattttttgtgtgtttatatttaatgaaaagatgtaatttcatttgtgatagctgaaaaaaaggctttccataattaagaaaatacctttatcagtagctatgaacatctgaaaaataatttttaaaaacttttaagaaaaaaactacttgagtaaaatatttcaagagttgtttaaaaatcttgtttaaaaccttt

SEQ ID NO: 535 - DNA, 340 bp, Homo sapiens
agcctggtacagcctggacccgtgtttctaggcgaatggatgagatattctgtcttgccgtgtgctaaattggacaggttcaggggaagataatttgtataaaaaggtagttctttactgctaactgccaaacttctgcaatcaaaaacacccgtagcagtaacttgacctaggttaaaaaagtgtgtggatgacaagctcagaaggaatatacaagcaactggaacaaggctttgacttaaaggtttggcgttgtttaaaagcagccccgtatacatattgtgttatgtatatgtattgaatgctgtatttttgctgaattaaagcacacttcaccgac

SEQ ID NO: 536 - DNA, 394 bp, Homo sapiens
cttctcctcgacagggcagctccttggtgcagctcctgctgcactgctggccccggtctggctctcttggtggctgtggccacccgtgccattgcatggtcctaacagtctctgtgtatattcagcttgcttcctgctgtggggccccactcctgctgcagaactcagcccctggttcaatgctgacctttgtaccccagtcccttaactacgcaggcatcttcctgtgtgtgtggtgttttgtaggtatacatctctctttcagcagctagctgaagtatgatttgcatacaacaagccgcatttatctaaagtgttatcagttgatatgttttgccttttgcaaatgacaccaaaagcatcaccacaatcgagataataaacagaccccccc

SEQ ID NO: 537 - DNA, 1321 bp, Homo sapiens
ggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 538 - DNA, 394 bp, Homo sapiens
acaagacataccctatacagacctatttgaattctactgtgggtttattgaaccagtgttggaacaacttcgcaaaacagaccaggccagttaggtacagcctcatgagttggcaggtagcagcagcccgtgtcttccctaagatgacattccctgcccaaaacacttctgtgaaaagtacagaataaacagctcagagaatacagtgtaagttacccgcagaaatatagtacttctttctagaagtttacaaactgtccatgtttatcccttgccatatagcaatcactactattagtgctgtacttaattatttgtttatctgatttctaattgttaatgcttcccccaaatattgtgtgacatttgtaattaataaaaatcacttaacgat

SEQ ID NO: 539 - DNA, 342 bp, Homo sapiens
ctcggggcgactagtcccaagtcacggaaacctctgcgcatccccgcccgcccttcccccggggtcgcccccgccgcctcctggcgcttcctcgctgcggcgactcctgcttggccgcccgagccttccttccagaagcccgcaagtctcccaaggtcactcgggacccttgtgtgcctggcctagcccagaggctgctcacctattcattttcatccgtactccaggaaataccaaaaagaaggggtcctggaggagagagatgggctgccgtgggtaggagaaaggagagggctaggagaccccgtaacacaataaaaagagactctccagcggaatctt

SEQ ID NO: 540 - DNA, 368 bp, Homo sapiens
ttgacatctcaggtgaacaaattcttcccactcttctgagcaaccatctcaaaatataataaagatgctgccaagaaatgaagtgccacaaaaagaagaaaagacataagaagatactgccaccagaaaacactgggaacagaaaaagacacaaagtaaatagattgctggagatgcagtctggcatgtgctatgaaaacaatcaccaatttctgcacttgattagtctgcccgtcgcctcagccattgtcagccacattgcgttattcgaaaatgcattgcaatgtatttagagttatgaagtcttagagtttgtacttgattctgtaaataaattattattatggctattaaaactttttaaaagc

SEQ ID NO: 541 - DNA, 360 bp, Homo sapiens
ccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccaggtgcaccgagggactgggtgtggggaggaagcgggatgggggttggagaaagggacagaaggcccaggttgaagttccattcctgttggcacgcagaatcctctggcctttgggagggtggagtggctgtgtcaatcagtctctgagccagtggagggcagggctcgtggtctgtgttttcatcacaggtccccacccccc

SEQ ID NO: 542 - DNA, 1418 bp, Homo sapiens
tcatgttgtggagcccatgcctgtgcgggggcctgatgtagaggcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctgagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctcttttcacccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctctgtcctctttggaatgtaacaataaaaataatttttgaaacatc

SEQ ID NO: 543 - DNA, 360 bp, Homo sapiens
aaagtctcattaagaaaatccttggggctacagccttgctgcaagccttccctgcattggctctgcagatttctcatctgtcctgacatgcagttttcctgtcattggaagtgggagatggggtaggttgtaagaaaatgatattaaaatgtaagcatggatactgtgcataaggacaaactatttataaaatgtatatgctatttattttatatatttatttatttcaaaataataattttatttttaatgagagatgcgatggctggattttcatcagaaagaataaggtcctactgaaacaggataaaatgagttattaaaggcttttactgacaataaaatttgtctttatattgt

SEQ ID NO: 544 - DNA, 383 bp, Homo sapiens
cagtctcttctacaaaacacacctgtctcaagtgggttgggggtggggggcactcttgccgagaagtcgctgtcacagtcgtgagctgaggacatctgcactgtggacatccctccaccagagccgtaagagccttctagctgcagagtggttgtttccacatggccacaattctgattgggggtcctgggtcacttccttcaagttgagagcctgggtggtgcacagtgtgaagtacacgtgtgggcggggaggggaggttacagcatagatgtgtaaacttaatttttttaaaaaaggaaaaatacctaagtttaaaaaatgactttctttgaataataagattgggttaaaaattttggagaataaagtcaatatttagt

SEQ ID NO: 545 - DNA, 362 bp, Homo sapiens
gccagttcccaaatgcctgctttcctgacccagatcacaagacaaagcagcaccattgtttatcctctcatcccacagtctattgggggatgctcctgcccaggtggccccacatcccttaagcccagctttccttggggacaggggtgtagcggaatagtatggcttgagacagggatgtcaggcgggaatcggcaggcagcaggtgggcacctggccacagcagagccttgcctcacagcgcggctcctcctgacccagctgaccgcgtctccttgagtggcccagggaagagcttcagggaccttcaggcagatcctcccaccagcaaatgttaagaggtagaatgcaaggcgtttaat

SEQ ID NO: 546 - DNA, 376 bp, Homo sapiens
ctcttcgacgcattccgcaggaccgccccttctcagctgctgcccagagcgcccccatccgtcaagaaggcccactgttggtgcttggttcccatctgtcacctagcgcccccagtgcagagcccagcataacctagagcccgctgtcaacagcgcccaccgagggctccccgcccccacgcagcaccagcgccaccgcacacctgactctgtccgctcacacagcctcaccttcacctcttgggtatttcagatccgctctggcccagtgggcagaggcatcgcctagagaaaataacctcagggttccctcatccctctgacaaacctgcctctttccctgaaaccattcaataaaacctctgatcaaagtgtc

SEQ ID NO: 547 - DNA, 1161 bp, Homo sapiens
gagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 548 - DNA, 655 bp, Homo sapiens
gaacagactgtcctccatgtcagttccttctggcttcaggcctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttatttaaaaac

SEQ ID NO: 549 - DNA, 369 bp, Homo sapiens
gatttagtaagtgagagcgagggccatggatttctgtatttggcacatgtcttgagcagttcccatgtaccaatccttgagaacctctaggctagctgaatttaagtataaattgccagtaattggaaagcatattcatatcttctgaaactataaggatactctcattttacttggttaaaaaacaagtgtttcctactgtcctctttacccaggttttaatgtttagtggtgaacagtagttttccctctacatttttttttgaactgataataaatgtatttggctgggagggtgacattgattaaaaaatgtatctcttgaatgtaaatatcagtattacagatgataaaataaattcctccaag

SEQ ID NO: 550 - DNA, 413 bp, Homo sapiens
tttcagaggctagcttttggatatcatttaatattctaggcctttccctatggctagaaagtctgatcattgttggcagaaaagagagtccaaacttaattctttattattaatagtctaccctggaaaaaaaatgaacgaaagagtgactatgcttatttttattttcattcacaggaaattttactcaattctttagctcagagttagaacaccaaaaaacaatgcaccgtaacctacgcacccccccgaaaaaaaagaaagaaagaaaagaaaggagaaaaagtagtcttaacaattcaaagtgaaggaatcatgcttcctgatggggaaaaaactgtttgcctacttgaacttaaatcttccttcttcattattcattcattcaataaataaaccatgattgaataccc

SEQ ID NO: 551 - DNA, 835 bp, Homo sapiens
aggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttcccttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcag

SEQ ID NO: 552 - DNA, 386 bp, Homo sapiens
ccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgt

SEQ ID NO: 553 - DNA, 339 bp, Homo sapiens
gtggccctgaccaccaaggtggcctgacctaaggtcacctgaccagtagacccccccatttctggtttgtttccttcatcccacgacgatgtcatatgtgtttacagcactgttcccatccccagaatgtctagggtggggctcagctaagttcccaggagaaccccaatacccagcaccgtgcagggctcagagaggccctcaggagggatctgttgaattaatggggatacatcagtggacaaatcgaagtctcccgccctcctggagcctacattcccacagggggaaacacactgtaggcaaacaaaataaatactaataaattaatgaaagaat

SEQ ID NO: 554 - DNA, 377 bp, Homo sapiens
attcacgtgtctcatcatttcactgaagatgtatggaacgcttccccctttcaaagtgttaagtactttgctgtcagcatcaccatcacagcctgcgaactcgacactaaagagagagaagtggaaaaggcaaagtaagaacaaaagccagccacgtcacagggctcagaactcgtcctgacagctggcccctccctccccaggcctgacatgaaagggtcctttccaagctcgctggagactctctgacccccatttcttccggtcctgagccccagctattgtggtttccctgcggacacctcacatatcaccgacagcagaccagaatcccgagccttctgttcttcacatatttcccacaccttttttaccct

SEQ ID NO: 555 - DNA, 367 bp, Homo sapiens
gcggttttaaatctggaggcttaagacagtttttggtagctgagggagaacagaaatagctatgttcactgttaatatagaatatgtgttattctttgcgttcacctttcccacctatattgtagacgtcactgatagcttgtaatacttttctacctgaggtttaagtatgtaaatatgaggaattaataacaagttaaactcttgttttgaaaatctaatttgccaaatataattgaggaaatactataagaactaaatctctactgatcctctcttaggagcaatttgagataatttttctaagtttaaagacagactttaaagcaactttccagtcacaacttcaaaataaagtacaagttaa

SEQ ID NO: 556 - DNA, 342 bp, Homo sapiens
catgacccctgtccctcaggaacttcctgggagaaggggagggcacctcccagcacctctagcccccactgaaaaaccagcctgggtggccctgagagggcagaccgaaagccttggcacctcctccccaaccatccctctgaaggagagctgggggaggggacggctcctcggctttggcctccaggacctggcactggataggtgccaaatgtttgctggctacatgaggcacttgttcctgcagaagggaaactgcacctgacaatgactgcttcctccacctaagtggggccttcttccctctctcattcattcattcaacaaatacacactaagctc

SEQ ID NO: 557 - DNA, 451 bp, Homo sapiens
atttgtacatgaattgggaaataaaaaatgcttatataaaattaaaaatcaataatatacaatatttacagcttgttaggtattatatataaacatagtttttaaaataatccttcaaaattaaactgttttatgtaaacatgcagtacacatactcatatagtttatagtcttaacagaaggggaaattgtgttcacataacacagggtacttcatcaaatatgcctttgtttttgtgtattacccctccaacatttattctcctgtctttaagcttcacagtacatttagtatttctatagtaaaaataaatccctgatggtaaacatatttctaaaggttaaagtgtgtgccctgtactacagtataaaactaacactgttcactagaatctctagtttacaacaaaactaaattttaaagtctcacacttaattttcttaactacat

SEQ ID NO: 558 - DNA, 422 bp, Homo sapiens
aattatagaggaataggcaaccaaaattgcagatttgaagagacgtgtggaattccttgtggctgagaatgaaagattaaggaaagaaaataactaaaggctgaaaaggccagacttctaaaaaggtccagtagaaaaggagctggatgtagatgctgattttgtagaaacgtcagaattacggagcttgccgccacattcagaaactgctacagcctcctcaacctggcagaagtttgcagcaaatgccgggaaagccaaggacattccaatccccagtcttcctcccttggattttacatctccagaacttccccttatggatctccctgagaatattctgaaaggatttatgaataattaaaatggaaggccacagaagaggggagaagaggaaataatacagtaatagttaatccagc

SEQ ID NO: 559 - DNA, 1114 bp, Homo sapiens
aaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcaga

SEQ ID NO: 560 - DNA, 546 bp, Homo sapiens
tgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgg

SEQ ID NO: 561 - DNA, 447 bp, Homo sapiens
tgggcaaatagaaaacagctaagacgacacacatgggcaggcagcattcagtggggaaaagggccgttctcatctcagctcccctcctttcagccctgcgtgcactcgagaaaggaacccagcagccgcgtcctgcctttcctgttttgcgcaccatcctcctagtcacccaggcttgagacctgcaagttcccggacacctcccatctagagagccacctggcccaccatcccttcctttcctcatctttgctgctaccacaccctaggttttgaccacataaatgtaggccctgccagcctcccagctcatccttctgctccagacgcctcctcttaacactgtcttgtaccacaccaccagagtgttcttccccagacacccactgctctgttcaaaagtcttcaatcaagcacatattctcaggatctcctgagggctgtgtc

SEQ ID NO: 562 - DNA, 1359 bp, Homo sapiens
ttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgccttt

SEQ ID NO: 563 - DNA, 343 bp, Homo sapiens
gcaggtgttaaggaattagcaaagcaggtgaagagtttgccagtggtaaattacaacctcctcaagtatatttgcaggtttcatcaaagacatttgtaactgaattctgttagaaaaataattgtgccagaaaaataattgtgcctggaaaatatacctctcaatgtataactcaagacctgggatgggatatgccatatatgtgctcctgtttaagaaaccaaatatgcaaaattgaaacagaataaatttaaatagagagtgatgattggcactacaagtcactgcagggtgtcttacatgatagcttcccagtccattttaaaataaaattcaaagtttt

SEQ ID NO: 564 - DNA, 430 bp, Homo sapiens
caaagtagttgtttataattcttccgcatcctccaagtgtatggagaagctcgcattcttcttgttttgtgctgtcattattttagtttgttatcttcgtctactttagttttctcagataatgtttaaattatttggcaaatcatttctcaattttcaatgcattaatttcctccacctgcttttctggagtttcatgtgatacccactctccccacacaggatgacttctcgagttgaatgttcattccatttattttcattctttcttgcttaatgttgtaaacaggcgaggttctaacttttcatctgtgtactacaagctctcaaattctttcatggggagtttgtatcatggtcattttctagtatttagcattttcagcttttgtttcctgtcaactcaacattaaaagttttttaaaacgtc

SEQ ID NO: 565 - DNA, 375 bp, Homo sapiens
ggagagtcccatgggtgggtctggaggggcagctctacttccctactgtcactgcttgggaatgtgggctgagagctgctgccacgtcttccactttttaagagaagataaaaatccatgcttttagtgtagtatctcaattttaaaaagatgttgggaactaattcaattaaggcttgaaatatacactcaacaccaaaagaaatggctcaggctggatgtggttcttcagccccatttgcaacctgtgctctatatgttatgtttcatcagcaagtcctttcgacactccttcctatgaatgaactgtgaagaaaacagcatggttgaaaaaagttcaatcataaggtgatcaaaaatggtcaactccttatt

SEQ ID NO: 566 - DNA, 342 bp, Homo sapiens
gaaaggactttctagagcctttggaaagcatgattctgccacatcttgattttggacttccagcctctagaactgtgagagagtaagtttccattgttttaaaccacccaatttgtattaatttgttatagaagccctgggaaacaaataaactactttagatcagttaggaaggcttcttgaactatatgacatttaaacagagacataaatgatgagactgtcccagccaagttaaaaatatcactgggaatcaaactcactggtgttattccagctcagtggtaaatgttctactggtattttaaataattctaaaataaagtcattatttttctttgc

SEQ ID NO: 567 - DNA, 354 bp, Homo sapiens
cactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattattggtatttctatgatatcacagtaaccaattaaatactatctgtaacttt

SEQ ID NO: 568 - DNA, 457 bp, Homo sapiens
tcattaatcagcacgaggcaacggccagtttcaacaccacaggcttcttgggtgactcagcgggaatgctccgattcaaggcgatggaccgcccgagcgtccccatttgtgaaatgtttccccatgaagaccctggcattctccttcctttggggtttcgggttgttggtttttccggtggtgaggtgggggtggcttagcggtgagggctccccctccttcccgcaggcctgggttgggatttgctgggcaggatacctgggggtatgcctggaccctcccagagggggtcccctcctccctctccaagggctgccggggagaacacgctcagaggaggcagctctaacccagggctggggactgccctgcttcatgattttcctgggggagagtcatgtggtccccaaggcttgggtgccctatagccacaccaccaattaaatcactgggtaat

SEQ ID NO: 569 - DNA, 343 bp, Homo sapiens
aattcgtgaacgtcatgatgctaatttgaaccaacaagcacccttgtgagaggaatctgcttttcctcaagtctgaagaacaccaggagaatctttctgtatggagttaccaggaatcctctgctaaggaaagtgaaagggaagatgcaatttctcctgggaaggggggatgctgatgtagagggtgacaagtaatatgccatgaaggattcagtcacctggttagatttagagttagagttatggttaaggaagaaggaaggaaaaaaggcagaagaggaagaaaggaagcaagaaaagataaaatttattctaagataaaatttgtgaattttgctaaact

SEQ ID NO: 570 - DNA, 358 bp, Homo sapiens
gctcaggtttaacatgtctgagataagaacctgtttccaagtgctttttaaaaaccccacaagaaacccttttgcatccttcacacatctcctttgattaggtttattactagatattctttaggactgcaataattcagatgaaatatttgaagaacacttgcgtctccactgataaactgacaactctggctctgaacctctggaaccaatgacctctgtttctaagcagcttatgtacgtctttttgctaataagtgcttctctaccctttccctcactaaattcactagtggcttgccattccatgccttccagattgtaatatccttgtttctcattctcaaataaacacatt

SEQ ID NO: 571 - DNA, 352 bp, Homo sapiens
ggcatgaactcactcggtttctgcccacatcactgcattcctgggatgccgttcacaggccttagcaagatcatctgacagccgcctgtgaggtcaacgaactttatacataattaaacactcccagttaggagaattcatttctttctccctgagaagcagagaaagaatacatgttgtgttgccctccattacggagtaaaagttgtgtggagtaatcaggctagtttcacatgatttaatgttgaaccgaataagaaagtgattgcatcctctactgggcctcacagaaaagtcaccacccacattgtttattcagactgggatcttggccatttggggtttaagccag

SEQ ID NO: 572 - DNA, 1389 bp, Homo sapiens
ggtacatgtatatatttgtcctgcattatgttttttacttgatataaatgtatttttactgtgatagtccaagtgccctgggggcgaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagattctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcattcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttca

SEQ ID NO: 573 - DNA, 358 bp, Homo sapiens
ctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtcgttgcctacagattttctccacgtgtccaaatggctttcacctgagctacttgttgaagatctcgtgtgattcagtcaggactgtatttggtcatttaatcagaaaagttagagcagagaatcataaaaagtgaatt

SEQ ID NO: 574 - DNA, 435 bp, Homo sapiens
aaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcacc

SEQ ID NO: 575 - DNA, 725 bp, Homo sapiens
cgtgagagcagtggcagcggcgtggaggaagaccatgaatgcgtgtactgttaccgtgtcaaccggcgcctgttcccggtgcctgtggatcccggtaccccctgccgcctgtgcaggacaccgagagaccagcagggccctgggaccctggcgcacgacgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgcagctc

SEQ ID NO: 576 - DNA, 461 bp, Homo sapiens
aaacatcctgttacacctcggttttaagcaccctcccctggcctctgagataagcctctcaggaacctgtggctctctaacccagtttgaaacgttttgctctccatagaattgtgtaccaggagagttatattgattaaattaggtcttacattttatgttatatattcagagacatatatttgtagtctgcatttcaggtaaagcgttttccatgttggaggtcaaatcccacgaggttcacgtatctattgctgctgctttaccctgttctggaaaagaaagttatttgcctgccgaacgcacagacatgagattagaaagtgatgacaagcgttaatgcttggctctttttatcatagactatactcttttctactctatttatttcatctgtgtttgtgtaacatgtatctcacaatgcagaaatcttttttttctttttgttatgaaaaatttcc

SEQ ID NO: 577 - DNA, 369 bp, Homo sapiens
tgctctcgtgagatcccagacgggctcaggtaaaactcttgcctattgcatccctgtggtccagtcccttcaagcaatggagtcaaaaatacaggtattactgttatccacattttacgaagaagaacagaggcttaggaaagttaaataaccaaggccatgcagcaagtaatggaggaactggatttctacctcagttctgtttggctgcagagaccaagctccttactcttgtgtgaagacttacagtgaaggttaattcctggctcctgtgctatgtaggggccatgcatctgtgtcttccacagtacctaacgtgggaccttttacagaatggtcactcaataaaggtgatttggttttgcagct

SEQ ID NO: 578 - DNA, 490 bp, Homo sapiens
acacgctgcgtgatggtggcttcctcggccctctccggggtgggcgtggggtggagtgccctggccagcctcccacctctgccttcattcctgccaccaccgtgcctctccgtcctcctcttccacttcctcctctccgtgtgcctcaggctcctgccagaagacattggttgagcccacaaggagactgtctggggaagggatggggagggcctggggtgggttctccccactgcccaccccaacccacaggagctccagctagggtctgggggaggatggagcttgctctgtgacgtcgtggccccatcactgctgctgctgcctggcgtcagccacctctcctgctcctctctcttctcctctgctgtccacaatgagtaggagggaggtgcagtccccacctctcacccctcaggtctgtgttacttggtttttaagtgactgattgggatagaaccctaaagaaataaaacttccagtggatacg

SEQ ID NO: 579 - DNA, 466 bp, Homo sapiens
ttatgtattgtgaatatgtgggaagtcttcttaaaaggaagatacgctcttactggcaaaaattaatttatttgtgcataaatatggtgttatttttagtatgtaatgaattcccactgattgtcaaaaagaatattctgaatgaaatgaatatggattgaaatagataaaataatttttacaggttttaaaatttttaatgacttattcctaggcttgtcaattaagtcaagaaattgctgagttctacttattggcagccttcttttaaatgtgataaattattgtttacactgaatttgaaggtaaaaatgttctgttccttttgttacaaactgtgattgaattagtcatgaattaagttgtatagtttggattttggttaatctctaaaatctaattttactgtatttttttccttacctcaagtgtaattttttaaaaaataaaactcgaaacaattctc

SEQ ID NO: 580 - DNA, 386 bp, Homo sapiens
ggtcccctgcccacccgcacctgacaaaatcctctctgtccagccacacttgcctccaatgccttcctcaaacccctccgctggcaatgatcacttcctcagcaatcagtgccccaggcccctctctcgtgtccctgcctgagtcccacacagggaactgagatcctcagggtccccagggcagatgctggaacatgctcacctctgaatccccccagggctctgcacagtgtggcccacagcagatgcctgccagctgctggctaaatggaactggctgcggggaggaaggctctggtgagaacagaggctttttgggacctccaactaaacgcaccctcccccatctacagtgtaaagaacactttatttcgaacagcaataaa

SEQ ID NO: 581 - DNA, 954 bp, Homo sapiens
cgcgcagggaccatgtcggcggagacggagcgccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaa

SEQ ID NO: 582 - DNA, 492 bp, Homo sapiens
agataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtc

SEQ ID NO: 583 - DNA, 342 bp, Homo sapiens
catggtttgtggggaacaatcctagaaaacactgactgctttacatttattggaaaaccaggctttggtttttaccataatgtgaatgtctttggtcttactgtctttgtttctggagtgggtagccatgattttgtgagttgtggagatagaatcttatgaatggagaaaacaagatagcaggaacgtctggctaactaatggtaaaatgtgaccttccccctctgcagaagtccctttacgtggacgagtaatgcttgtgttagaaatatatacatatgtaactaacctgcacattgtgcgcatgtacgctaaaacttaaagtataataataataaattt

SEQ ID NO: 584 - DNA, 1236 bp, Homo sapiens
gatcccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcagtccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcc

SEQ ID NO: 585 - DNA, 359 bp, Homo sapiens
agaaagaccttctaaatttatattaggacatagtgagaagaaagccatctgaaaaccaggaagagagccctcaccagaatctgaccatgctggtgccctgatcttggactttcagcctccagaactgcaaaattctggtgtggtgtgaatgctgtggctcagtccgaacatgtttttttctgtaattttatcattattacacgattgcaatatcagttttgttttttaattggaaagcaacattttctactgttgaaagacgttttttgacaaattgacccttcctagtattgagtactaagttgaggactgcatctacttgttttttacattatagagaataaaatactattgatttg

SEQ ID NO: 586 - DNA, 351 bp, Homo sapiens
tccccacagagttgacgctctggaaagaaaagccaggcttttctctgaggttttgcatctccttggccaatgtgctcatgccagagaagagcagtgcatggccagtttgaggagcacggccatgtgaccttggacagcccctgcctctctctaggactcactcccggtccctaacctcagctctctgatctgtaccacaaggagctgccactaacacctgtgtcagaactactgtaaggaccctttcctcctgcgagaggagaacagtgctaaacctgtctgaacgtgatagacatgctacaaactgccaaccctttaggctataaactgctcacacatgggccaagtgtc

SEQ ID NO: 587 - DNA, 445 bp, Homo sapiens
gtatatataaaaataaaaagaacatcagacatcaccatcacctcgcttagaatccatggggccttctcctcaaattcaatcttcccaggcatttcatgaacttgcgtctagtttctgttccctctcaaattgcccaggctgtcctgtgagtgacagcagctatttcgtgggcctcctctggaatcatgagaagtcacccaaacaatctcagttttctagctcactccgtcttgacatttctacactgtcatccttggttttcttggaaattaatttgcttttcttcattgtctttctttggatctgctttccttttgttggttactattttatttttagcttctcacaccataccgacatatgttggttattcttttagacatgttttttgttgttgttgtcacctggaacttttgtatcttgaataaatttggggatcaaatac

SEQ ID NO: 588 - DNA, 343 bp, Homo sapiens
aaaagcaatgaagctagctcttggagtgcagaagctctcttgtgctgggccacttccctggtctcaaccaagagagagttggctccactaaagcagaaattctcagtcccatccacaatcactgacttcttctaacaagtcttctgaaaatctctttactaatttctgaaatgaaattcagaaataatataacctacctatgcatataatttttaaaatcagtgtaaggtctaaattgaaacataaagtagaaataatttacactaatacatatataacattaataatgaataattattatattaatagccttacaataaataaattggtttttaaatacagt

SEQ ID NO: 589 - DNA, 355 bp, Homo sapiens
cctcatggtgactttgctgaaggacacaaagatgcttccaagttcatttgcctaagagaagactgtgaaaatctgaatttccatctctgacttgttggaaatttggtgaattatccactcagattcccgagttaggacctctactccatccagtgcaggagttctgctacattctaacagttgatccctagactctacctaaacactgtcagtgctggtgcacatgcatcctttaggcctatttattccaagtgagacagctctgcttgttagaaggttatttcttcaactaagccagtctgtattctttgacttctttttacctcctcatcctcatggctattccatctcatta

SEQ ID NO: 590 - DNA, 353 bp, Homo sapiens
gacgtgggctgtgatgtctattgctgcacacctgggggtggaaccactgtgtcccgtggcgactgtgtgttgaacgtcggaggaaccgccagcctgttttccgtggcggctgtggccacttgacctttgcacaagttgtgtgtttggattcgcatctccacctccctacccttgttactgtctctttgatcacagccatcccggtgggtctgattttctttgtacaatgcgagccccccctcaatgaatttttgcttaaaaaaaagcaatttgttgtttttaattgaaatgaaaggaagcattctttcctatgcatgtgttttttttaaagcaaacaaaattaaaatcataag

SEQ ID NO: 591 - DNA, 339 bp, Homo sapiens
aaaactttgaatggataaaaaagaagatgaggaaactaaaaagtcagattgaataatatagggaatgattattctagtagattgtgaaagagaactgtatctacttgcagagttcaaacttttcaggtttgttttaggtaagcctattttatattagaaaataataaatgaaagtggtgattatcttatatttaacataaggatttaccttgtcatttgtttaaatgtattgactgtatgactcaagttataacggacagattatgttagaagtacatcttcatttaaacgaagtacattgtctaaagagtctcattaataaagtcattcatttgcaac

SEQ ID NO: 592 - DNA, 339 bp, Homo sapiens
ctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacac

SEQ ID NO: 593 - DNA, 340 bp, Homo sapiens
atgccgccgggagtccacgccaagttaatggaatatttcctgtaaatattattttcccttcctgtctcatcatctcatttcattcaaaaatctttactaatccgggggagtgaaagtaatgcatcaatttccagagccaatgcccctgcttccgaaatacccttaggaatcactggaagccaccgcggctgcttagggacaggggggcaggccgtttactctggttccttctcctaatgcctcagaggggaccccatagtgctcctaattgtgcatctaagtgtacataaaagcccccctaattgcacatcaaataaataagtaaatgctgtctgctgaa

SEQ ID NO: 594 - DNA, 895 bp, Homo sapiens
taacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcagacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcag

SEQ ID NO: 595 - DNA, 393 bp, Homo sapiens
atgtgaaggaaggaccctgcagaagtcccaaatcaatgttttcttgcttatccctggtggacgatggaggctggtggcaggggcattaatgtgtggccatggtggtctgtgtgatatggtgaaaatgcaaaggagatgaactcccaagacttttgggagacatttataggaagatgggtgctaagtaaatccaaggcagtcttttcagacagagggcttgataccactaattaggcagcttggatgagtggcaccatggaactggctggtggttttcttgtcaaaatagacacaaactcccttctctccatgtccttagaagatgtgaatttagaggtctccacattgcctgacaaagtctgttttaactgggtaaaataaaaaaaaaattac

SEQ ID NO: 596 - DNA, 716 bp, Homo sapiens
tttagcattagcaattttttatttttccttttttgttgcataggaaatgcagtacttgcttccagtaattgtattgtaatgtgagaaggtggtagcactaatggttgaatacaagagttaaactaatccacaccagctcaaaaaacctgtggagatttagttgaataagaatggacgcccacagtgattctcaaccaattacaaattttcacagaacacagtaaaactaaaagggtaactatgagagtcaatacaagtatactagaggcacagggggcccggctcataaaaacagatttcagaccaagttattaacacggggggtgtttcgtttcataacagatctcttaccatcactggaagtgttccatcccctccccctacaatttgaaatggaaaacagaggtattccgagtggacagatttccatgtgtggtgggaaaagtccccagtgaattttgctctggtgagagggcagggctaagggtggggcgggggatcagggatttgcctttgagagtcttcctaaaggacctcctagaacctgataaagctcctagtctaggtctagttagtatctcagtggtgaggctaccaaatgccttcgcagtgcagagacgatggtctgagaccagggagaaggcaccgagccgttagttctctcaagcctctgtcccagcggagctagcggccttatgtacttcggttgcaatgtc

SEQ ID NO: 597 - DNA, 364 bp, Homo sapiens
gggttcatttctgaactggactcagcatgccatatgacccatggagatattttcctcatgagatttgacacaggggtcattggccatgccgcaccctagctgatgactgggcaagttaccaaaaaccatctgagccagcctcctcgtctatgcaggggaataatatggttctgcaggatggttgaggtcagggaaaaatgtattcaaattagcaaattcttgccaaaatacaaaaagcgagattcttcccaccaactctcactcatcatatagaactactcagtgccccatgtatacaaatgtaacaagcctgcatgttgtgcacatgtaccctaaaacttaaagtatcatagtaataaaattt

SEQ ID NO: 598 - DNA, 359 bp, Homo sapiens
gagagaaagaaaggtaggcaatgatatgtaaatatcttgcttgtttaataaaaaactgacaaaggaaagcgtttggaggataaaaaaagtttgaagtccattgaggaaaagaagaaagttacttctgctaacccttcccccaaccctcaaatgacttacaatatggggctggagaaagtgggtgccaggaaaggggcaaaacctgcagccagctgagaatggtggagagacatgaagaccagagagggcactagggcaagttcatccagtgtgaacgtagcccttttaaataatctgatgtatacatatgtaactaacctgcacaatgtgcacatgtaccctaaaacttaaagtataat

SEQ ID NO: 599 - DNA, 432 bp, Homo sapiens
ctccctcaccagcctccactcagcctccagcaacacctccttgtctggccaccgtgggagcccaagccccccgcagctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgcca

SEQ ID NO: 600 - DNA, 341 bp, Homo sapiens
agcttttgcggtgatggacagggaaaaagtgggggagcagttaattatccatcttgacaggtgtagacacaggctgggaagctgggtgtgtcttaatccctgctcctgaaccaccgtggggagcaggaagcctacagtttccttatatcagcaaatgcatcatgttgaaacaattttactgcttgctttctgaatttaaatatagattttccctgagaagggctcaagcatgcagatggtaagaaaaacaacagtctagaaagatatcttcaagttccttctcctggttggtggaaatagagcaattcttttccaaaatataatttttagagttttaaagt

SEQ ID NO: 601 - DNA, 562 bp, Homo sapiens
cagcatcaccatgaacggagaggccatcgctgcgctgagggctgccaggcattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtgaaggtcttggccctgttccctgtcctaccaataacgtagaataaaaacataacccactgaaacagg

SEQ ID NO: 602 - DNA, 430 bp, Homo sapiens
accctcaggagctgcatcccagcctcaaggccctggtgagaaactgtgctctccagcaagggtctctggccgtctctgcaccgtgtggtcagcttagggctgtgcctcccaagacaggacctgaggatgggtatgggtagcagagatattgctccctttgctcctgggtgtccagagctccagtgcctgtcacctcacctctagcagcctcaggagctgtgtaaattctgtcatatacatgatgagggagatcatgaagcactcacttgaatcataaagtctgtctgggggaggctgcagagtaaatattccactttccccacttacaggccccacaaacaagcctcagaaatgtgtttggagggaccatgacagcatctcttagggacttgtgttatttagttttctctctctctctctttttagtggc

SEQ ID NO: 603 - DNA, 413 bp, Homo sapiens
atcacatccccatgaggtgggtaccctcattattcctgttgtcctcagatgagaaggcggaggctcagagctgtcaaatgacttgtccaaagacacccaggcagttcatggcaggacagaatttgagcccaggcagtctggcgtgctcagccatgctccctgtgccctgggattcgggaggattgtcacagatgtctactttccagggacttggggagacaggcttcaggctctatcacatgatgatcctggggccgacttgtgccaaggctgggctgggagggaagatggcctggacgcacagcgtaatcctgagtcccctctctgtggatgacgatgagttacctttgccctccctcctgagatctctgtggttctgcccttcattctccaaataaaatcgctgtggcctc

SEQ ID NO: 604 - DNA, 467 bp, Homo sapiens
agtaacatttagtttctaaaaaatgcagtttggtcgttttggggtttgctgcccagccttctcccttcaccctctccatttccagcatcactacttttatgtgtacaaggatgtttgcattcagtaacccctgtgtgtttactttgatgtcccagcactaagaaaagggggtggggtaggtgttggtgctgtttgtttgtgcaggcctgaactttagtcactctagtgtgagctactggactaaatcagctgctccattggattataaattatccttgactctggaagacttatgtctgtggagacagtgtgttggagaaaccaggtggtacagattgctggtaaggccctgctgatgcttagtggctacatatgtcctgtgtgttgtaagagctagtttttgttgttggtgttttgttttaagacagagtcactccagcctgggcaacagggcgagactccatctc

SEQ ID NO: 605 - DNA, 440 bp, Homo sapiens
actctcacacacagaaccagatgtactcttgaaaaagggagcatgagcatcctttctctaggtagatgtggttggcggcattataaggtgaaggcgtgaagagctggtgccatggtgtggtgataaggcgactacagcgggcatctgggggtctggattccagtcaattctgctggccactagcttgctgtgaggcacagaaaactttacctctctagacaggggtgttggtaaaatggccaacaccaattggtaaaatggccaattgctatctatgaatgtctgtgatactaaggtggaaaatccataaatgtcaacaacaataaagaaggataaattaggcagttacaagaaaaataagtgctaaaataatgatttttttttcacagagcttacatcaaatgattatttagatatagctcagcctcttggaatctggt

SEQ ID NO: 606 - DNA, 399 bp, Homo sapiens
gtggtggtggctgatcctgaccgtcctcagttttgtgaagcaacagcctctgtgcctctttctctgcatgctctgttgacggtctagtcttgagagagaacctgctgctgtcccgtctgtcatagccttcctagcaactcttaggcctgcgtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgct

SEQ ID NO: 607 - DNA, 387 bp, Homo sapiens
aaagtttagctatgccaacaaaagctgtgacccccttcatagtaacaggacctacttatttctgaaccacccatacagtgacaacaaccctcaagattgaagaaggctgaaacaataaggccttcataatagcacaaaccggagaaatgggaggcaagctgttcttaggatcatgacttggagggtagaaaatttgtcaagattgatgtgatacccacaagatctctgaaagacatagtccgtcttttcaagtcaacgtaagaggcctctgggataaaaatgggtaacgtccatggcatgacttatcagacagaaaaaaatgacaaaggaagaagtgctgaagctactcaacaaatccttctgtgactcgatcagaaattaaaagtt

SEQ ID NO: 608 - DNA, 395 bp, Homo sapiens
ggaaaactaagcattaaaattgattattctaaaacataaagtggactaaagccatcctattttataattttctaatgcaaagtggtttagtatagagttaacacttagaagtttatagtttactgtttttattcttatgtactgtaaggaccatatttgagtttttggtctattcctaccattgtttctttgtggggaggagttggagcggtttgggggattggttttttttttttgtttttttaaactacaggtatttgtaaaacaatgtttgggttcaaacaaattagttgttaaacatctgtaatccagttttctgtaaatgttgctgttgttctaagctctgttaatgttaagcattctttgtatataaaattacaataaaatgttaaaac

SEQ ID NO: 609 - DNA, 371 bp, Homo sapiens
ggaaatgatgtaaacacctttgaaaaggagtgaagaagccctattggcttcactaaagatatacacaggcactaaactagaggggtgcttaccagaggtatcaggcttagtaacattctaggaatatttgaaggaatactgttatatatttaaagtataatattatatagaacaagtgtataaaaaactgtcccaaatactaacagagtataggtagagaaaaataaaggccagtgtcttctcagtatcatgttagtattatttcagacctcattaaagaataatatttaacgtgaagaacatgagtaataaatcaatatgaagaataaattctaaaattttaaacaatgaataatgacaatactttattt

SEQ ID NO: 610 - DNA, 442 bp, Homo sapiens
catcactgcagtgaaagtctctgcttacctgtctggctcagcttgggcaagggctgggccatatgtgctcagggacgtgcttctcttgtaaggcaggaggatagaagaggaccaagaagggagggagctgccctgtggtgcacacaggcctgccatggggcgtgggagcccatcccgctgcctgaccggagctggctgctgtggtggactcaggaaccacttttaatactgcaactgctcccttttgcccagtcagggaaagctgactgtaagtcccacctccccctccgtccacccttctagtggtttctctgagaggtttctctgcttcagctgtgcttgaagtggcatgcctcctctgctgcagggctcccccacccccacacggcctctaaagatgtttatttccttatagactgattaaagtcagccattctttttc

SEQ ID NO: 611 - DNA, 444 bp, Homo sapiens
gctcctcagatgcccaggcatccagcaagggctccgctgctggtggaggtggtgctggtgagcaggcatagcagaggccctccagagagactgccctgcacgccatgccttgggccacgttggcagtgtgacaggactgtgattgtgctagatgtacctgcccaagtctgctggtcacatttggcagcaaaatggatttctcctggggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaaattctttaaaatt

SEQ ID NO: 612 - DNA, 343 bp, Homo sapiens
gtggattttgaaacaaagcaaggtaaagccttttttttttcaccttgcattggcaaaactacctcttcagtgtttttaacttttgattcaaaagcatcttaccaataaggataaatatcatacatcgttatgaaaatattgctatgagataataagccacatatgaatgttgtatacaactttagggtttacatttaatcctgaagtgttacctcctttcatgtctattacactattttcccatttactaagtggggagggggtctccttatatagtgcttcatcgttaataagtcaatacctgttgttcctgggatgttcttttttgtgcattaaaaacttc

SEQ ID NO: 613 - DNA, 505 bp, Homo sapiens
tggttatattcggggtgtctctgaatgccagcataaaaattcacggaattgaatagaaattggcctgtcttaatgacctatggtttcttttttaatgttttgaaataattaaagagagtttagtcacacagggaggtctaggtgaactgatgttgaagtttattactagacttttcagacctaaaaattttatttattgttattacttgaatatgtcaaaagtatattactggacaaccttttacacattcctctttctaaaatcgaattggacaattacagttctctggttcagaaaattacattagctcagaacccagtaacccttgataaccctgttagcgcagcaattcccgagtgtgtgctttgtgcagagcgttggactatgtactgctcttgatgtggggacagcggggacagagagctgtcattgaaatagacatctgtttaagaagcgatacttagatgaacctctgtatttctgaaaaataaatgtgaaatatct

SEQ ID NO: 614 - DNA, 341 bp, Homo sapiens
gggagcagctttggagggggtgttgctgccccagccagagggattgggggctgtggctgagcaggagacctggccttacaccccttccctggtaaagggccctgggttctccaccacagcccctctttgtcctgctctgagtggtttggagttctttgtgcagtggcccagaaatatggacgcgcaaactgtaacagagccccacccacacctctgggtagcgaagcacccatatttgttacatgattgtcttaatcctctttaagcaaggattagcgataactagggggttaaacaaaaatcagaaggaaaaactgtaagttggggaaaatctatccatg

SEQ ID NO: 615 - DNA, 358 bp, Homo sapiens
atatacaatattaaaatccattcaagtgagattattgcttaaacgtgaagcaaattattgcaaaacattataatttcaggaaaaatatagagaaataaattatgacctcagcatagggaaggattccttaaacataatgtaagccatacaggaaaagatcgacattacattaaaagtatttcttagtcaaaagaaataccataaaaagaaatgaaaagacaagaagctagactgtgatgagctatctgcaacatacatgatagcaaatgattactctccagggcagaggaaaaagtactaagggtaagtaagaaaaatatacaaataattcaatacaaaaattaaccagaaacaaggc

SEQ ID NO: 616 - DNA, 362 bp, Homo sapiens
cgcatgcttcaggaaagggaggggatgctgtgacagcaaactcagcccaggagcttgttggggaaggagaaagggcaagtccctcgtggtccacagcaggcaccccccaagcacctcgataaccagtggcaggtaggctgaagtgaaggaagcctctgtcaggaggtctggcgcccagtgacagacaagacagctgtgagggagctggggcagccctggctaaaggaatgtctgagtaacttgtgaaactggaagcctctgcctctgaatgcattccaagacctggtgcaaatggatgtccattcattgttttgtatcagtgttcacttagatgtcttcttgaaaacttgtttgtggaataa

SEQ ID NO: 617 - DNA, 785 bp, Homo sapiens
gatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 618 - DNA, 399 bp, Homo sapiens
agaaaaatccagtgattaaagtcatgcaaggagatggcctggggcttgctaaaagtcaggttgcagtttccattgcattcaagaaaatcagaaaaataaatacaacttttagaagaaactaagttttctcccattcatgtttagctattggggggtctcatacttctggacttgcttagacctatgctatctaatatggtagcctctgcccatccatatgtggccactgagaacttgaaatgtgactagtttgaattaagatgtgctgtaactaaaatacaccctggatttcaaagacttaataaataatgtaaattatctattctttcctgttgattatatattgaaatgataatattttggatatgtttgggttaaataaaatatattactaaaagt

SEQ ID NO: 619 - DNA, 416 bp, Homo sapiens
gatggtgcaggctcaggagtcggcttgcaaggatggggaggggcttgggaggaaggtgtccccatcttgctcagggccccctgagtggacagcctgctcccccacacccctctagcctcatttgggcccagaatgctctggaattggcagtgttttttggaactgtgtggagctgcatttccgctgagaaaccctatcagtcaacgtcaccttccatcccttactgtcgtcacacgtacacaagaggcataatgcccagcgctggcctggctgcaggcaagcaagcagtcccagaggacactggtgggagtgttcatgattgctgccttgggggaaaatacattggcagtgtctttaaaaataaaaacccacgataccctttgattcagttcctttaggaacttctcctatagaaa

SEQ ID NO: 620 - DNA, 1009 bp, Homo sapiens
gtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggttcagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtg

SEQ ID NO: 621 - DNA, 498 bp, Homo sapiens
acaggaagcagtcttcactgttttgttttttccacctaggaagttgtttaggatcctaattctaattcagaggtgcattctacagagtcttctccattgcctttcctctcaaaattaatcttgattggcttctctgggcatttgcgtgaggaactgaaactcattttcatagataaatgagagaatgagtttcctcagctccctaaagggcattttgcttctcccagctgaaaggctcccctggattactaggggctaagtgggagtgtctagtgggttgacccccagcaacgtgcagcagcctacagggaatccccaacaaaattagttttaaaaggcttgtccaagaaatgaatataggagctggtcattccatgctttgagccctcctggaggtgctagacctctggagacaaaaatgactcagtggataacacgctatggagtcctgccaataaccagcacacttcaacccattccactaaaccctaggccttt

SEQ ID NO: 622 - DNA, 409 bp, Homo sapiens
tctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcag

SEQ ID NO: 623 - DNA, 391 bp, Homo sapiens
atgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttg

SEQ ID NO: 624 - DNA, 430 bp, Homo sapiens
tcctttgtgtcttacctcatccacctctcgcatccccccttggaacaagatagcatcattaccctacatctcttgaaggttcaggtccctgggctgcaaggagataagaggctccctcacacagcctctggagggctaaatgagatcctacagcaatgccctggtggggcttctctctccctcttatgtcacttgtcacacctgctctaggtaatcattttcctccagatgagaggtgtaggaaaggacctgatgccagcaaggaaaaaggaattggtaacatgctctttgtttacctaaaatctgtccccacaacaagaatgtaacttccttcgaggcagaaattcaattttcttctcccagcccacctacaaaggcccactcaagagcaagttctgtgtaaaggtgcttaactaatacaggttctttg

SEQ ID NO: 625 - DNA, 435 bp, Homo sapiens
ctgtcatccccttccttgttttttccttggggagactaaatgcttatctgaatgctgcggctatgcttagactcagaaaggttttgcagtaccccctcttttgcagttgctttcagcgtattcttttgaaaatcctccctactaacaaatctttgtcctttgaagggtgaatttgatatttggaaattaccaaaagcctctttggagccgagtctgacatacaagtctggatgatcaggctgaggccaaagtagggtgtgaccctgtgtcctgcaggcctctagagtctacctgggagagcatgcccacgacaaaggacaccaaagcaggcacctttgccgtcaataacttggatttttttttctcatttgttagataggaataaagatactggttgtgagaattaaggagacgaacgttccggtctatttgttg

SEQ ID NO: 626 - DNA, 496 bp, Homo sapiens
ccttttcctcttatacgtagctttttttttttttttcatcctggtgaacttatgtatcccatttagtgtgagatcaccatgagttcttaagaatgtctgtattgcaagaaaactgcctttggatgcttcatgcctgatacgctgtaagaggagatacttttaagtcatttttctcaactgtagtgagagactagtatactttggggttgaatctaagtccttggaggccagcatatttttgcatatgcgtgaatgtagaagcaaatgactggggatattgttaagccatcagagcttaaaacatacttgactctgtgccaggggtgctggatatttgtccccagcctatagccatctcctaaataattgatttaatttttcctgcttaacaatgaataagtgattgtgcttgggtattaaacagagaaaaataatccaggccttgctttattaaaaactgaatgagtttaaattattcagacatagaataaatagg

SEQ ID NO: 627 - DNA, 369 bp, Homo sapiens
cctgccaccctcctgccctgccctccaagggtatggggggcctgggcagtgctcaacctctgcccagccttgaccagagaccttgctaattgacaatggacaatgctggtgcccagcccagactctggggtggggcagtgcttgagggggtccttgactgtgggacctgaggggctctctggcagctcctcacgtgtgcacatcaccttatagtcacccttcatcctgggtcattgagagtcctgtctgcagccagatgccagcaggctgtggtcctgtagtccctgagccatggaggcagggtgggctcatcctgtgcaccttgttccacagtctccctctttcccaatttacaagaagaccaataag

SEQ ID NO: 628 - DNA, 415 bp, Homo sapiens
gtggaccagatgctcatgtgttcctgggtgcagtgtctgtgttgggggctggccccaccctgggccagggtgcatggagggcatggccccagcggggaggaaggtgggcctagggctggctccagggtgtggagagcctgggagtggtctccgtcctggggccccaggaggttcccgcaaggagcgactggggcaggtgctggaggaggtcagtggacaagatggggagatgtggaaaccccaaaagccccttctcaggcagccctgcctccaagaccgacagatggctaagggggccgcagacctggctcccccagctcctgtgtggagaaagggcaacagctgtcccggatggttattctctcctttcctcaaacacatttggaactcaagtaaatccgatgcatgttgggtg

SEQ ID NO: 629 - DNA, 513 bp, Homo sapiens
tatatgttaattgctgttttaaaaatctgctcagctaagcacgcttagtgtaatcagtcaccatggagttttttaataggacagcttctgctcttacagagcagagtttttatgccagtaggttagaagcataacatgtttctatattgaagtgattctccaacaaggacttcttttcatcaggggtgacctaaaagttattacttgaaatataattacatcatgttcttaactgggtttagtagtaggataattacaaggttgtatccacctcaaataggaagaactgataagttttgcacaattatttaactcctctgttaggccttccttatttcctgttctctttttaaaatttgactaagatattgctaatgggcttgggagcctataaaatgatcagaattgttgccttatgttttgcatgtttggggtaacattggagccagatgtactcttaaataaaaggtaggcctacaaaaccagtttctcagttgcattcaaaatgtgatt

SEQ ID NO: 630 - DNA, 350 bp, Homo sapiens
gggtctgaagggctgtccacacatttctggctgacttagaagcctctgcacacatgcaggtaaaactagagagatcccatggtacccatttgtccctggttggctgggaatctgcatgaacgtatgaaggaaatgtgacagggctgatccgaaaggaaaagtgggatagacctgaaaactgcttgaacttttgctccctaaccctgcacagacccatgggcagaggttggaagcctagtaggctcaagagatgcaaacacaacctgtaaccaatcattgcctgatcactaagctgtgtgtcagcaagtcaggcttaaaaataaaaacaagaatttgaaaagaaaaactgg

SEQ ID NO: 631 - DNA, 1040 bp, Homo sapiens
gaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttc

SEQ ID NO: 632 - DNA, 388 bp, Homo sapiens
aatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttcagacaggactattgcttgttgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggt

SEQ ID NO: 633 - DNA, 387 bp, Homo sapiens
aaaatggtgtgcggcagggtgcagcgagctgttttcacgaggcctccaggtgactggatgtaagcttgcttgagaactatgggttttagctattctggtgtctccctgattttctacagcgccaggatcctagtttggtgaggttttaaatttaatcttatttttatataaaatgattgccagacgtactatattaagcttgaagaagcagaagatccctgttaatgtgtatggcccaggccaagagctgtcaaatgaaaaactttgtgctgaagcaggtttttagtatgtatatctttttgatggtatgaagaatttatttaggcttgactgttttaaaacaccataatgaatgtataattaatttatgttaaagtattaaccctt

SEQ ID NO: 634 - DNA, 374 bp, Homo sapiens
gaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaatt

SEQ ID NO: 635 - DNA, 392 bp, Homo sapiens
ctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttcc

SEQ ID NO: 636 - DNA, 417 bp, Homo sapiens
agcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactttgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccaggctggg

SEQ ID NO: 637 - DNA, 412 bp, Homo sapiens
tgagcaagtggagcgagtgtgggctttgaagggtagcgagcttgcaccctgaccggggagggcccgggtcacacagttgttgatgtggaacaggtaattgccctgtttggagttgcctgttctgcccaggaatgtactccagggcctgatggcgatgctggaactcgcactacagtaaataattgataagaggaggcagttgtagggtccacttttagctggaagttcttaggggacagaaaaataacttggagtagtgagtggttctgagtaagctcaggaaacgtcaaataaaaactggatctggtcatttaacacgcagctcgcagatatccagtgctagaagaaaacaccaaaacgcggtaaaattctgtatgtgggtccacttcccgtgtctggcgattaaaataag

SEQ ID NO: 638 - DNA, 1083 bp, Homo sapiens
gacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattc

SEQ ID NO: 639 - DNA, 479 bp, Homo sapiens
tcagatgtatgaatatgattatatagtcatgattgaagttcaaaatgaggaagcatacaaaatcctcagccactgaaaaattcagttaacttgtttatactcctgtaagctctagttagtcacaagacaaagtatatagtaacactttgtaatgaagtaacattttctgcccacattaattttactaaagacctaaattgttaaaattaattgccaatctctggatatattatgcttagtaagtgttttgaaattaaagaccttaaacatttcagcaagtaaattttggattctagctctgttttaaattgaatcctaattttcaaaccactgctaccccagattcatacctgtttttgaaatcttgtttatggaatggaaatttgacagtatggtaatagtttattgactgattggacaaaggatattctggttttaactgacttttccatttaaataaaattcatttgataattttg

SEQ ID NO: 640 - DNA, 399 bp, Homo sapiens
aaattatgtacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccattt

SEQ ID NO: 641 - DNA, 436 bp, Homo sapiens
tcttgtggcctctggaatgtgacacagaactcaagagacaggaaggaaatgagttgaaggctgggacaggggtccctgccagggatgctggtgactcacatgacggtgttgatgtgtggagtccggtgcctggtttggggagtgttcatgggatatgttccaaaggactgacggacctatcaggtactggaggtgaatggtcaagtctgatctcagggctgacagtgtcaggcaaggacaggaagttgacgttggactcattggctgaggttgcttgggacccagggagcaacgtgtgccaggacagatgggtctggggctaggaaggcaggtttgggctggagacttgggcttgggacgcatcccaggtagacagtggttgaggctgtggaaatgaccatgattgcctgggatgagagtggagacggacaagatt

SEQ ID NO: 642 - DNA, 413 bp, Homo sapiens
agaagtcagtctattgtgaaaagtttcagatgagattattttcttttagtctttttaaatatcactatatgtatttaaatagaagcaataaactagagagagtgtttcttgaaaagacaatgttttatttgccaccaggcagaacagaatgagcattggtagagaaggctccctcttggtatgttactgataaacttgtacttcctcatacttgtttgtggttctactgacttatttccaaacttaagagtaatgtacttcgaaaacaacttggttattctttaaatttcaggtaaaaccccttttcctaacactcatcttatttccactgtcttatttcctctcagatgttcatatttcacatgttcaaaatgaagcgtactatttcccctccaataaacgaagtctcctgc

SEQ ID NO: 643 - DNA, 346 bp, Homo sapiens
catagaaatattttcgtagtacaatggagaaagggaatcattaaaaatcagagtggagaatggttatgtatattgtatatttcagttagataaattgaggaagctagtataataattattgaaggtctcaataattttccacaaaattctttaacttcttcagctcaaccatttctgtacttctctactatgaatcagaggatgaggttgtataattcaaaagcattgccttagtctagaaataattattgtacctatcatttagttttagaaataaaaagcaagctgattttttttgatgaaccatttatatctgtgatggaataataaaatttcacacttccgg

SEQ ID NO: 644 - DNA, 409 bp, Homo sapiens
ctgtgctatgatctaaagcctctcatatctgtgcagcaacctggggtgagtcactgtcactaacatggaacagatgccaggtagtccctttggacaaaaggatgaggcccatccatgtagaaagcatcttaatcagtgactgtcttatgggccctctttgtttcccatctgttttattatcagaatatataattttcccccaagttttcatcttgaatctctcaaacctacagaaaatttgaaatttgacagtaagcacctgtatatccttcctctagtttgtcttattgttgacattttatcatgtatgctttatagacaggatttttcctgaaccatttggaatatgcatatacttcatccctcagttcccagcatgtaccctaagaataaagattttcttctgcat

SEQ ID NO: 645 - DNA, 365 bp, Homo sapiens
ttctttatgtccagaagttgcagcacctttctttgtctctggaatgcccaagatctctactgcatcctgtagacatggagggtttccccccttattctgggtctgattatttttaaagaaacaccctttccttacccatcatggagacactactaaccttgtatatacttttattagagtgctgataacaccatattacagtagcatacttacatatctgttttcttaactgtgagctccttgagagcagggactgtgtgtttttgcttttatttcaccagtactcagaactatccacagtatagaaaagcactcaataaatggaataaatgaaaatgaatagataaataaatgatttcacttgt

SEQ ID NO: 646 - DNA, 404 bp, Homo sapiens
atgtctgtgtgccatcatctcattccatctggtcattcctttgcccattcatccatccattcattcaagtcaccccatgcacattttccaagactgcctgtgacctggccctgtgccgggcagagctgaggatgccaaggtgaattcctcctgtgcctggccccggccccagtctgctggaagaaccagacacagacaatcacactgcggggaaacacgtgctccatcggaaaagtccagagcagggggtgggcagagaggcccagcgtgcaccagagcctcgctcaggtcagcgccaggcctgcctggagcagccaactgtgggagaagaaggagttggtgaaaggtgggtcccacctgggccgtccacagaagggctgaggggtagggggtgaggggttgaa

SEQ ID NO: 647 - DNA, 377 bp, Homo sapiens
acaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtgatgacccagcagacctccaaaaagcctcctctgcccagatctccagccgggtctggggctgggttgcggaggggagggtctgggagtccacacttctccaccaacttcccttcccactctcttattccacattgcagtgtttggaataaaccatgtttttatgcctcct

SEQ ID NO: 648 - DNA, 874 bp, Homo sapiens
agaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggaggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctaa

SEQ ID NO: 649 - DNA, 440 bp, Homo sapiens
gcctctttcttcttgcctccaaagcagctgatcaacagaaggttcggaatgaagaacagtaacacgtaacagttccaagtgttcctttgtgctaaaatttaccaaagcttctgtggattgaggcagttaatggggggaaattctatcaacctaggagtagtttaatagatattagcttggaattaaaagttcaaggtaaattgtctttcctttatctactcacttttctttctgcctgtgtgattctatttccattaatagagtaactaccagccatgagccttctgtttgctttggcccctcctatctttccttattttctccatcaggttctctcccttggccacttctgcttcctcttctcttccatatttctcctgttcacactcttcctttttaaaatgccatctttttggacaaacaaaatggttcaaaacgtt

SEQ ID NO: 650 - DNA, 442 bp, Homo sapiens
ttaaacttcttctaatgtcaatctagaaacttgttttagtagtgcattttgagagaaaccatttggtatcatcttgcatggaaacatccgcttccttaggaatgaccaaaaactataattagtgataatgaatcttttatgatttggcaagagtgttttaagtggagttcttttgatgatatgattgttcaggtcaggctgaaagagccccaataataatgtttttctgactgttttcctctggtaatgtttgtgataaaattcctttgtcataaataaatattgttgctggtgcagactgaatatttgtattcccccaaaattcacatgtcgaaaccctaacccccaatgtgatagggtttggagatggggcttttgggaagtaattaaggttagattaggtaatgagggctggtccttcatgatgagattggtatcctta

SEQ ID NO: 651 - DNA, 492 bp, Homo sapiens
tacaaatgtatacatatacacacataaatatatacacacatatggatatacgtacacacatatatgtggtatgtgtattagacatatacatgtattatttatatatgtgttagatatcctacatgcctttgtgcctaaaatatatatttatttctatatatcaattatatctataataccaaagaaatggtgaatttttcagtgttattaacctggcatccagatcatgtcccttcaaggaggtctatctcaggagaaagtcaccattgtagtctggcagacaatgaacagtgcttccttgggaggccagtgggtgagctgggcaagggacaatggccgtcaggggactatcagtgctctctggtgctgggcagacagtctattgttagtgacccaagaagagtccctctgactcctgccaaagttgacagcaattggaaagacttcacccttaaagaggatatccactaatctggtccctgcttgcagcta

SEQ ID NO: 652 - DNA, 417 bp, Homo sapiens
gaccaggctgagaattctgttgaataatgaaagcatttggcccactctctaaaatgcttatcgattatgatcaaaaatgatctttctttgagattattatgatcctgtggagggagactgtcaggtaagaattgtgaaagactttgcagtgtgccataaaaaggattactgagtgtctcatctagcgcccttcagggttatctgattcgatagggacccgcgctttccatcgtctttgggctacttatctctgtaaattgtagaaatcttatagtagtgcactttgagtaatgcaaatttcttttccaaagaaatgcaaataaatgcaaattttatcctgtagaatataaatatggctattgctctgcagatactgacccgttttgcatctatttataaattcatttttgcactatc

SEQ ID NO: 653 - DNA, 413 bp, Homo sapiens
gagtctacagctccaaatgtgaaaatgaaataagatcaaactcaaagaggggttgaggacaagtgagcaagtttgttgatgattaacttgcagatccttcccgtgtcccttaccctctggactggcctttgctgggtgagccttgcagtcaaagccggcagctaggatttggggtgcacatgtctctctgctagggctctgagggcatggggactctgttcttggagctgagaaaccttgcttctctttccttccagccttgcgggccttgcccgtgtgggactgcatcagagcgtactgaaatcactggccctcatctggtttcagagctgccagttaagctgttagattctcccacccctggtgacagtgatgcacctaggagttaagggagtagatttggagaccccttt

SEQ ID NO: 654 - DNA, 1519 bp, Homo sapiens
attttattaggaatgtttcaaccacatagaaaacatataatagaaaccaatatagacaccacatagacgtgggccatgttaacattctaccgtttgctcattttttaaataaaacctttatgaagacattcacatagcatgctttcactcattgaaattgtacaatttgggtttttcatagaatttgcaaccatcaccacattaaatatatttatagaatttgcaaccatcactgcattaagtctacttatagaaattgcaagcatcatcactataaactttagaacatttttatcacctcaaaaagaaaacccctaggctgggtgcagtggctcacgcctgtaatcccaacactttgggaggccgaggtgagtgaatcacttgaggtgaagagttcgagaccagcctggccaacatggtgaaaccccgcctctactaaaaatacaaaaatcagctgggcatggtggcacacatgtgatcccagctacatgagaggctgaagcaggagaatcgcttgaaccggagaggcggaggttgcagtgagccgagattgcgccattacattccagcctgggcaacaagagcgaaactctgtctcaaaaaaaaaaaaaagaggtgggtggattacttgaggtcagggtttgagatcagcctgaccaacatggtgaaaccctatctctactaaaaatatagaattagccaggcatggtagcgcacgcctgtaatcccatcttcttgggaggctgaggcaggagaatcgctagaacctgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttttttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcaa

SEQ ID NO: 655 - DNA, 407 bp, Homo sapiens
cacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatct

SEQ ID NO: 656 - DNA, 383 bp, Homo sapiens
gagaaaaaagaatgcataagtcttgagggaattgagacaagctgggggcctcatgctattgtgagtctccctgcagcccaagtggaagcttggctcctaacaagcacaagctgccaattgttaccttcttctgagagccttgctaaaaaagtaactctgggaaaactcttataggttcctgaccatgaatccatcttttttattccccccaaaagttattcaactattagatcaatggataataactatgaggttttgggtgactatttagatggaggaaagtgtattaaggttggaaactaaattctatccttaatactactgttttctaatttttgtttttttgcctgatgtaaatgaaaggcatatatgttaaagattgg

SEQ ID NO: 657 - DNA, 534 bp, Homo sapiens
gcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtg

SEQ ID NO: 658 - DNA, 415 bp, Homo sapiens
aaccataaaaaagtacagatttacagctgaggaagctagttctccccacagcttttatagactccctcattaagagcttccaggtatgcagagaatgtcacagcttcaggaattggaatcagttaaccacatctggatgctggatcaactatagtagggaaacggggagaggaaggaagggtactaagatctcaggtaaacaattacaagcctcaatgtctgttccatctccaaacggaattactattttaaaactgaattgggaaaaaggcatcctgaactattcatgctcaaagagtatgtggagaatgactataatgagataggaaggggaggacttcatctggcttggaggttagagacttctgaccaacataggaacagctgctgaaatgggatgaaagaggttaataag

SEQ ID NO: 659 - DNA, 341 bp, Homo sapiens
aaataatttcatgttttccccaaagaaaaattaagcctcccaatcttaggatccaattgtgcagtagaattcagagacttctcattcaatcttgtatcctatgcagctacaaatattttttaaatgttagtaataaacattggaattttgtcttaaagagttcaaaaccttggaacccagttttctcactacgtctataaaggccattacagacccaaggctgttttgcagttttcatatgttgtttgctgaagtcattgtaattttttttgcctgctttgcctttttttctacaggagttttgagtgtgaaatgaaaattaaagtttggtacatatattt

SEQ ID NO: 660 - DNA, 439 bp, Homo sapiens
ctgaatggctccttccatactttctaagtacttctctgctctgtacattcattcaacacacatatcccaagtgccagtgagtgccaggtcagtttacaatccaacatggtatgtgctacagctctgccaagccactgcgaaatcagccctcattagcataggtttgaaacatgcctttcaatgcactctggggcttccctggatctagctctcttcctggagagtaaacaaacaccagaaagcatgaaggacaagcacagctccagaagatttctcccccaagatcaaatgtctgtattcctcatgggctcttctcacaattctcccctgaaactctgcgatggaagattgtcactcaatgtatagtataatgactttccaggttttttttctaccatgacccagaagaagaaatgtcatgttgccaacgaggactaag

SEQ ID NO: 661 - DNA, 454 bp, Homo sapiens
aggatgatggagctaacaaagatacatactttagaagaaaagaaaataggtaaggaaatgaagataaatgaaaaataatattcagaaaagaaataaggctgaaataaagttagagcacaataggacatactgtcattcactaggcatttcctcaaggtgccacatatttgacacggcttcctatctgctcaatagacagggaagcttgaggagctacaaggtccagagtgtccgtggggaaaggcaaacctgccgctgagttggaagacaacagctgctaatacacgaagcctcagaaagccctcgccaggactcagagattctctcgagtgactcgtgtggcaaacatcctgtattaaaaacaagataacaaaaataaaaagttcccaacttccaaatgactatgttttataacatccaactctgaaagccacattcatactcccccaccacc

SEQ ID NO: 662 - DNA, 729 bp, Homo sapiens
ctcccccagagggaccggcccggggcggggagatgaacggcttcagcacggaggaggacagccgccaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaaaaaaaaaaaaaaaaaaccgcggccgc

SEQ ID NO: 663 - DNA, 447 bp, Homo sapiens
gaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatg

SEQ ID NO: 664 - DNA, 337 bp, Homo sapiens
gcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaggagctacatcagaggttttggtagatgctgctgtagacctcatatccgatgaatgggaagctgctaatgccatacccagcaagagaaggaagcaggatgcagccccgcttgaggccgccagcgtgccttctgcagactgtgagcagagc

SEQ ID NO: 665 - DNA, 1060 bp, Homo sapiens
aaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccagggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctcctaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataatttttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagt

SEQ ID NO: 666 - DNA, 384 bp, Homo sapiens
ctaattggcctatctgcagttgcccttggtccacccttgagcccactctttaagcctgtctgtcacttagagaagtacaagtacttcctgctgagaataaagccttgatcgcaatttcagtgaattatcagggaagtgtgagaataagtaggaataaatgtctaaacatttgggaaaaacttgtttgcaataaatgtggttaacagagagtgaataggcttactacataaaattgttactcatcaattaaaaaaactgtacaatcctcctccgggggaaaatgatcagatattttaagtctgctgatatttttctctggatgtcagacctgtatactttgtcctgcattattggagtataattggcaaataaaagttttatgta

SEQ ID NO: 667 - DNA, 341 bp, Homo sapiens
actcttaattagcataggagatgtaggaattcaagcagaacctgtataaaatgctggaatccccagttttatgtgatgaaggagagaatctcttcagttttcaagattttttaattgaaagtttttaaacacaaaaatcacataaaacttgattcttgaaacatagcatcttcacatatagacttaaactaccaggtaagtatttgtcattcactggttttcaccagaagatgaatttgtatcataaaaagttatcaacatgggccgggtacagtggtttatgcctgtaatcctggcagactttgagaccagcctgggcaacatagcatgaccctatctct

SEQ ID NO: 668 - DNA, 1373 bp, Homo sapiens
ggcacgagcaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcacgtcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaatggtttcactatga

SEQ ID NO: 669 - DNA, 458 bp, Homo sapiens
caaaagtagcacactgaaaaaaatggggaaaagtggagtctagatcacaaactggtaagcttggtgatgttctctagccaaattcgaaggtaataacattgtattatggctttctgtttaaaagcagtttcgcttatttgattattcaacaaatctttattaacacgcattacgtgtaccagaaactgtggtacacttaactgtggagctggggaagcaaaagtgaacatgccgccttaagtgagttcagatggcttatcttccggttggggaggcatcaagtacacaggtccgttgtaaaccagtgtcttaagtgctaaccttatcacatttgctattagaggatattaaacatgtcagacttcttggagaaagttgatattttcatgttccaagtttgggaacatcattgaattcagacagatctggattgaaacagattaaagtgcctacacttt

SEQ ID NO: 670 - DNA, 380 bp, Homo sapiens
gtgtgggtggggccttagggcgaggcgcagacataccccgaagtggttggattgtataccgcaaggggctggatcgaaccccccaaagacactggaaggctgtgtggctgaggagggcccggcagatccagtgtgtcgtgggctttacaggaaagagctccaccttctctggagtgtgcagatgcgatctaggtgtgtccacccgatgggagctgcgggccgggcagatgctgccccagtacaaagctgatttggacctggggcctctggacttccctgattctctgcttgcatctccagcaaagtcctgtcccgttggctgccttcatccactctctcacttctctgccttcagagtaaaattgcaagatctgtggtgc

SEQ ID NO: 671 - DNA, 785 bp, Homo sapiens
caatctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctc

SEQ ID NO: 672 - DNA, 404 bp, Homo sapiens
aagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaag

SEQ ID NO: 673 - DNA, 1220 bp, Homo sapiens
gacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctccgttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccat

SEQ ID NO: 674 - DNA, 437 bp, Homo sapiens
tggagctggggccccagcagtgggctctgccatagcaggcgccataagctggaatttgtgcctccaggcctggagggaccaaggcgtttctgatgaagccgatacattcagaattggggtccaaataggaaataatgcccttttcaggctagtgaaaatgttgaactctaagagataagtttatttagagactggattgagcttttgtttaagatttcccacctgcgtaaaattcctttcagcccataggattcttgattctgaagtccagacagaagcctgtgttctgtagctgctgaacaaagatgagagatcactggggctgctgtttgtccgaagtttgtgtgggtatcatgatgaaccctcttctaagaagtaaaaggatcttttaaatcaaaatagacaactgcagtcagtccaccatgcccaacgacatt

SEQ ID NO: 675 - DNA, 400 bp, Homo sapiens
ttaattttttcgagtctcagtttcctcacctgtggaaaaaagtggagtaatagtagtgatctctgagggcttttgtaaggattaaattagatgatggtttaacatgctttcattgtgtcctggcagattgtaagcactagagcagtggtccctgctgttactaaaagtgatggcattgaagaaaggcatgatatttaatgggatattttttaaatttactcacaagtttgtagaaatattttacttaactgacttgcgtatatttttcccacgtgaaacagacgcagtaaaacgcaggactcttcccgcttggattcgcgaaggtcttgaaaaaatggaacgtgaaaagcagaagaaattggagaaagaaagaatggaacaacaacgttcacaattgtcc

SEQ ID NO: 676 - DNA, 377 bp, Homo sapiens
ttcaaagggagacacagctgttggcggggatgcatgctcacaatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttaccc

SEQ ID NO: 677 - DNA, 511 bp, Homo sapiens
gtttctgtaagtgccacaaccaaacatcatcaggtgcccgaaaatatattaaggaggctgaagggagatttcgtagtgttgaggaagaaaggttgggttgagaatcacaacatgtaagttttaatcttggatgccatttgggctgttgtagaccactgaatgtctggttatgccttcctttaaaatttttcaggctaaaattttatgaatcagaattttgggggcttggtagtgattcccctggtctccaggtggaggtggaatagccttctttgcatttaggcgtccatcattactagatccttccactctaagaagaggatgtcagctattctcgtagcctgtgagggcccatgagtctgtatttgatgagcacaggatacttgcattccaggaatcttccaggggctatattgtcctattctttccattaaaaaaaaattattaaaagtttggctataagaaatagtgttacctgagaatgaattaagagatacctatttcttaaatt

SEQ ID NO: 678 - DNA, 444 bp, Homo sapiens
cctctctctttgggaaaggaggtgatcccgaggcgaaggcgcagatcgataacctgcatattggggtgcgcgtcagggtggacaccgcagcaggcgcctttcctccctccccacgtcctgagtcagctctgcgccgctggagcgaaggccgtccccgctggcccactttggggtaaaacgggttcctggcatctcgcgggcgcggtcgttcgccccgcatctggtcaggacttcgccccccggtagatggcttgggtggcttgtacagccctgggaggcgatgccctgtctgaagtcctctgcatacttagttggctgtcaggacagtgcctcccaggtatgcggcaaagagatctccaaccgcttggtcatttccagccactgcgtctccttcacgccaaagggccaaaaacttgagcgtgaaagttgagtagaattagtatt

SEQ ID NO: 679 - DNA, 776 bp, Homo sapiens
cccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccaa

SEQ ID NO: 680 - DNA, 441 bp, Homo sapiens
gagcagaaaagcctttgtttacaaataacttgggaacctgctagaggaaaacttgtatgacttgaaatcacattacttaatgttcatatgatattttcattttttccggttctatttagtagagaaaagtagtttagtccataaaaaaagaatttagaattatttttaaaattagccctccagtttataaactggattttaatctgccagtaagtttattcaagtaaatatgtaaattgatgcataaaacagttgattatcaagtttgcaagaaaatgttacctgttaactctgatattaatttcaatggttaaaaagtcatgtaaagaaagttaattattttacagaatgattgctttatgaaagggaatgttgtgatttacctatataatcttttgtaattataatttgtaattaaacattgcagtgtttcctgccctt

SEQ ID NO: 681 - DNA, 398 bp, Homo sapiens
tctcctctacaatcccaatgctctagtataaccgagccagtcactaaagctgccctcctcctactgttccctatgtttcatattcctttttctgaggctctacctgtagacatcttcaagacccaacccaactgtcatgaagccttctccatgaaggctatccatataaccagaataagaagtggtctttgcctccttgaacttttgtttgtaccacttttatgtttcttatccaaaaaatggccttaagttgtaattatctgtatagtcatcttccccactaggataaaggattgctgaatgatacaatttgttgtatacttctgtaacacccctcctcttcattatctggcatgtacatcgatattaaaaatattcattaaatgaatgaatagctg

SEQ ID NO: 682 - DNA, 479 bp, Homo sapiens
ctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatagtaataaattgtgttattttgtaaaa

SEQ ID NO: 683 - DNA, 419 bp, Homo sapiens
gcagtgagggagacagccccaacccttttctccaatcccccttccccaggttcctgggctccccttctctctaccttctcccccaacgtctgtcccatccatatttgtctctctgtccacccactcctgggggggccttccccatctctcctccaggccccccggggagggggaaaggagtttggggaggattcgtggtcttcatggttttatatataatatattaaaaaatcaaaagtctgtatgaaaatatcagattgcacccccctctccccattcctggcttttgccccctttttcttgttaaaaaacaaaaaacaaaaaacaaaaaaccacacacacattttgtacggggtggggaggggaatggggagggggtttggcaatctcactaaccaccattaaactgaggagagaac

SEQ ID NO: 684 - DNA, 430 bp, Homo sapiens
aaggcacagaagtgggaatgtgggtgtcatatgaagagaccttcctggatgaattgcagagtttggaaaagcgtaaataagccacatttgcctacaaagcaagcttcaatccatatgcaatgtgcagaagagttaaagtaaaaaataaaagtcctcatccccccaacaatcccattcactagaggtaactactagtaagaatttcatgtacatatttttccagaaattgtatcatactctgcatacagttctgcatcttgattttagtcacttagcagttcagtgttttaagacatctcgtatcagtacctcttgctgtaccccactgggtttttcttctgtgattgggtagttgtcaatcacagtgaatgaatatatcataattttgcattttccaattacttggttggcttcaagttttgttgattac

SEQ ID NO: 685 - DNA, 362 bp, Homo sapiens
cccccctcctccccaaagagtacgttgtgtagtggggtagagtggaaaatcaatccaagaaaagtagcaaacggacccaaagatgaagaggaagaaaagaaacagcaacacgaaacgaaaaaaaaagccaccagatttgttgcaacgttgatgtaaacctggccgtcttcctgaaccagtgacccagggtttccgcttccctttgctgtcatcttgctcaagtctagaagctgaaatatcatcatcaactcgacatgaggggataacctctggatccactcatcagatgctcatcagacgttccaattacaaaactgaacctcttcttagtgctggggcggttagaatgcaaacatttcaag

SEQ ID NO: 686 - DNA, 795 bp, Homo sapiens
aggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctg

SEQ ID NO: 687 - DNA, 873 bp, Homo sapiens
aagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagctattcgaataattcaagagagaaatggtgtattacctgactgcttaaccgatggctctgatgtggtcagtgaccttgaacacgaagagatgacaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactg

SEQ ID NO: 688 - DNA, 1005 bp, Homo sapiens
aaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgttt

SEQ ID NO: 689 - DNA, 377 bp, Homo sapiens
aatctacctttccacttctaagcctgtttcttcctccataaaatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgattt

SEQ ID NO: 690 - DNA, 396 bp, Homo sapiens
agtcagtgacttttagtgctccctgataaatgatgttattgacaaaagtaaaaaattatttcattgtttttttcctgtattactatctcctctcctgtgcttttgacagtgtgtttagtggatggataatatgtatttctctttcccactcccagattccaaattccctgcctttttggcccacctcaccacaaaagctccatagtttattaatgtaagtttgaatggatgcttctttggggaaacttcaggagttaatggaagagtttcagaaaggaatgagaatgcctcaggagttgttctgtgatggaaattggtctgttgttctgttaatgctgatggaaagaaacttacaacgcttaataaaaatctattcttttagtaaaaaaaattgtg

SEQ ID NO: 691 - DNA, 391 bp, Homo sapiens
tgtagagtgaaagactataatggtggccatgtagaaactaatattccagaaggagagagctccaagaaggggattccagtgaaccatatgtacactgtgtttgagagacattagttccccacggagaagggatggatagtctgtgcttcgggggtctaaggaaggcttcctgcaggtgctggtacctccttaggtctggggtggttccttctaagtttccttaccctgcctgcatcacctctgcctcttatgacctctgtgcaaagactgggaagggtcacccccaatggctgtgaacgaacctgtttgtgattctaaacagggcacgggaccatcctacaataaaaattacccagcctaaaatgccagtagtgccagtagtccctgttta

SEQ ID NO: 692 - DNA, 338 bp, Homo sapiens
gcatatatactgtagggagaagtatcaaaatcatttaaggtcttttttccaaactagtgttcccctcccacatcccaataactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttatt

SEQ ID NO: 693 - DNA, 341 bp, Homo sapiens
ccgccaaaaacggactccgccggctatcctcggcccggtaccagttgttggatccaagagaattccggaacccaaacggctcgctcaaagcactttattggcagtgaaaccgcaagtaacccggagccctcggcgcgaccacggctagaatcagagcctaaggcgtgtgagctcggccatcccacgtctgtcttcacgctcatccgcaagcccgacacaccggggctcccacttaatgaatactgaagagtagggctgtccctaccgcttctcacttccttgttttcatcttttcgttattattaagcgacctaacccaataaacatattaccttgttggt

SEQ ID NO: 694 - DNA, 365 bp, Homo sapiens
ctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaa

SEQ ID NO: 695 - DNA, 405 bp, Homo sapiens
atatttctgtcaacatgggtaaacctcaaaaatagtattaatgaaattgaactacagactattttatataatacagtataacgtacaatttcaaaacatgcaaattagtgttatgtatttttgtcatggctaaatactatataaaaaggatctaaaagaattaataaaataatcatcagattcagaacagtggtgacctgcagggagaaagacaactgagattggggaaaggatgcaaatgaaaatacctttaattattcatttcttttaaaaataagcaaatactgtatagccaattcttaaaatttgataaagctggctgtgagtatatgagtcagttcttactctctgtatctttctgtataaactatttcataatgcaaaaaaataaagaatatttaaatg

SEQ ID NO: 696 - DNA, 439 bp, Homo sapiens
caagaggcctcctgtgccccccaagaggcaagagaacccagggcaccccggcggagcaggaggcggggagcaagatttcatgtcagacctcatgaaagctttgcaaaagaagagaggcaacgtgtcctagggacgggcatgatgagtgttccagagggagaagcatcgctgaccccgagcgcaggttttgctagcagattgccctgacatcttgttcatttcagataaaatgtgatgggaaacttctcactgatgtgctcaagtacaggcataaccattaacccagtagagttcagaatatctgcccaaatgtacatatcgttcccatgtattttaacctaaatggaatgtatcttcccttccaagctgcctaaagcgctgttttaggttcatttattttattatgttcagaagcatcaaataaaagttaaacgttttt

SEQ ID NO: 697 - DNA, 916 bp, Homo sapiens
actgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttgggcttttattcccttgatccacttgccagttttatcactttacccattgttcctcgatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgaaaaaaa

SEQ ID NO: 698 - DNA, 338 bp, Homo sapiens
atatttttcaaatcatgaatctgattccatatacatatgtgccttatattgtgataatttatttttaagtgaaatatgctatcatagcctgactttatgtatagtggtgacaacttgcaggatcgcatttctgtaaccaaacggccgacagctgaggtgtagatgcttcctatggtctgtagaataatcactgggcttgttctctagctatgtctgtatgcaatcgcgacagtgttgatcaaaacccatgatcattctctccaaaggtctttgtcactaagccactagggattctgaaaagttcgtgagctgaaacaaataaattgagttggaagatt

SEQ ID NO: 699 - DNA, 438 bp, Homo sapiens
aggggtgtcgcgagctagaactcttccccgcccctgtgagctcgggctgttcttcctcctccgcgtggctcactccagcctcggatgtttcctcgctgcacagacctgctcgggaagactcgagaaggccaccccaggactccagctctccccggaagggcttcccctcggattgcgtcttggcccctggaaccctccctctgtatcctctgctgttcctctcttggcctccatttgggttgtggcctggatactctggctcgctgcttcccttctcttaaggatcacagccctgcactgcctgtcgtccggtgcctggaaaccattgtattttttggtctgattttgtagttgtttgagaacttaagtctggtccctcacactccatgcccagaagcagaaatgagtaaagtttgttttatcttttcttaatatgac

SEQ ID NO: 700 - DNA, 400 bp, Homo sapiens
aaaataaattatagaagtgaccccaaagttccagagaattggctccgtgtcccattttttcttccttgttcctggtttgtcattctgttcatttctcttcttggatttgagaaaggaatctgttgactcagcagcccagggctgcggttctttctctctgggatccctgctcattagcttcctatgcgtggctttcttccctgctggctctgggctataacctctcctctcatcctcttcagggaatggagaaaatttgcttataactgtgatctaaacataatcatgcaataggtaccctaaaaatactcaaggaaggaagtacaaaggacagactaccaattgataggacgtcttcttggatttcatgattgatacattagatttctttactctgggc

SEQ ID NO: 701 - DNA, 416 bp, Homo sapiens
agggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgcc

SEQ ID NO: 702 - DNA, 471 bp, Homo sapiens
gaatagaaattgtaagagttaaaaatggaataattatctattatctaaaaatatcttctcttgctcttttctagctaactacttaggttcaacctagttgaagaaacaatgcctagaagaaataaatgcttacaaaagatacccatcagtgggtggtatgcagatagcccttgtcttcccttcagggctggacaccctgaccgccatggaggtggccacacagcatcccttcagggatgtggagtgtggagaccttcagatgcttcagagggaggatatgagtggagaagttctttgcatgtgtttctagagctagagttggtgtcctgtttttttgtggaaaggatagagtttaaaaattaatctgaactttttcttcccctttcttcagattattgttataaaaatactatggatgctcatttatttcagctgtcagtgagaggaatcagactaaaaccttgttgaagc

SEQ ID NO: 703 - DNA, 431 bp, Homo sapiens
ttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaa

SEQ ID NO: 704 - DNA, 371 bp, Homo sapiens
aaataaaaattaaagtcagtattcatactacagtttcataacagaactccccccccccataatatttaggtattcaatttagaaatggttaactgaaggcaaccaaaattttaatactgctggatattgggtaaaaagactgcaaaaatgaaagtgatatatacttacacttggtccttgggtttcctgcagccatttaagaatgtgggtcaaagagaaagttttaaaataattaaataattttgtttgtctgagagtacattaaatagttaaattttacacaatttaatactgaaataactccattctaattatcttaagtaggctgtttagaagttcttaagttttcaacttaattattttcctttttt

SEQ ID NO: 705 - DNA, 399 bp, Homo sapiens
cgggcgctcgggggcgggctctgcacagcgacgtcacgggcaccgtgcgctgggtcaaagttcagccccgcccccgcttccccctcgctgtctccctcggcctgtgccgcccgcagatgcagcaaataaaactcactcctgcgcaaacacgatgggagcccttccttcctccctccttgaacgagcgccgggggctggtatcccccgggaggcagcagctcgcccggtccttcgcgtcgaggtcaccaccccggaaaaacaggttggaccgaggtgctcagcgcatcccggccccgagagagaagctgtccgccccgcggccgtcggccccgggtctggtgctccgcggggaggaacggcggggaggtcgaggccgcccccacagagcgcctcgggcgg

SEQ ID NO: 706 - DNA, 414 bp, Homo sapiens
ctttgttctcttcaaaatgttccaagttaaggagtgaagcctaaatatgttcattacatcaaaatactggtacccccagtgtacgggagccagaggtgtacacattccagtacttatttgttatgacttgtttctatctaggagagcaatatattaccctttcactgtatcagtttctttggtccatccaaccaggtgttgttgtccttctataagaagaaatacttaagctacacatagtagtagatgacttattattcagggtttctctgactgaaatgtcactataacatcagtcatttgactcctaatccagtagatataaacagtgcctggaacagtctattataacactctgaaaacatttggtaaatatatgaattttaataaaaggaaagattgctgctcaacacc

SEQ ID NO: 707 - DNA, 403 bp, Homo sapiens
tcctttttaatagcagaggccttggggtaggggatgggagaacctgtctaagaaaacctttagctctttgttgtaggcctgaagactgttctttcccctctcaactttgaataaatactcctggggtctcattctcccaactctacatattgcctcaaaaattggcaagcccctggcagcccctcccagtgtctgcagaagagtagtgtataagggcttctgctcttgatggtgtatttccttgatttttcctctcaagctgcctactctacctgcatctccccatcttttaacagtgcctattaaatgatggcccatcaatattgttactgtaattcctaaactgattttcaaagcattcttatttttttctatcagagataaataaatcatttaggaagag

SEQ ID NO: 708 - DNA, 463 bp, Homo sapiens
tgtaaatgtttaactagaattactttttccatgagatctttccacctgatttaagggagagatcactgggcagtttgagactgaacccacgtcttaggggaaggaaggtcactcttctgtcctctacccacaagaacatactgtaactctactgcttttcccatccccagagagagggagggagagagaggtggatgaagggtgaaagacaagcagtcttcattcttttaactttccctggtacctgcctatacaggtctagggtggggtctggaggggatcctaacttagtcaagtggatcactgaccttgcagtttcctcattaactgatggcaggaagccagagggctgggcagcttccacccctgcctcccattgtgaaaagaaagtcccttttaaatcctcccctgcctcaccccacaagtctttgctcccccaattcctaaggcatggcatatggat

SEQ ID NO: 709 - DNA, 421 bp, Homo sapiens
gtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcac

SEQ ID NO: 710 - DNA, 346 bp, Homo sapiens
tcccgggcggtgggtgggaaagccggagggagggtctggctggcggcagcgcgcaaggccgcaccgggtcacgcttgattcccgcggaatggggcgcaggttgccagaccgggtccccagtgctagggctcaaggaagaatttgttcatgcagaagatttagaaaaatactatgtaaaagagtttggagtaagcctcccttaatataaatgagatttattatctgccggaaaaagcagattatgtttcttattactgaacgcctgaagtaccaacgactcaaccagagcccacagaattcaatatcctgggtggtaaaaggaacaaataaagcaacacggaaaatt

SEQ ID NO: 711 - DNA, 337 bp, Homo sapiens
ctatagacaggtactattatgaccccctcaactgtaacataggctggaaggtcacatgacaaggaagtagtggagctgggatttgaaccccaggcagtctggcttcatacttgataagcttaatcacaatgccaaactggtaaatagctgtgtggcataatttcaggtagtgataagtgctgtgaaggataaagcaaagaaaggggcagggatggctctttggagagactacttagggatggctttcaggaagaggtggcatttgagcaggggcccgagggattgatgtgacttgtgataaaagaaaaacttcagacgaattaaatttaaagaagtt

SEQ ID NO: 712 - DNA, 386 bp, Homo sapiens
aatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgtctcttacagttctagaagccagaagtctgaaatctgcatctctggactgaaatcaaggcatcagcagaactgctccttctggaggttctaggagagagcatattccctttctcttttggcttctggtttgctgccagcatccctggcctgtcagcagcatagaataaatcttcaaggccagtgtc

SEQ ID NO: 713 - DNA, 1771 bp, Homo sapiens
ccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatcta

SEQ ID NO: 714 - DNA, 597 bp, Homo sapiens
cctttttctgtggtgagatgaggctcctcctgccctccttgctgggtggtctttctgttttgaccacatcccttggaagcgtggctgggctgcgtaactccagagcagcctggtggtagctggggctgccttctgagtttgggctggtggatgctgagtatttgcattcagagccttaggcattgaccttggctttctgggaccctacgcccctctgtttgcctttgtcagtagagaccttctcacatttagggattcattttttccaagatctgtttgctaggtgtgtgtcaaacttcctcccagagcagtgacatggatgggaattgtgagtgtgttgagagacctaccctaaaagatggggctgcagtcatcctcaggggacctcctgttctcagctccacctcagccacacttggctgtgggtcagcttcttctgaatcagcatccgcaggacagcgccacccagccctgccacacttgcttcctccgcgcttcttcagaggctggagcccacccccatgctcgtcgtctgttctgcttttttgatgcacttacttgtccctttcagcgtattgcttatgtcctatgttggtt

SEQ ID NO: 715 - DNA, 407 bp, Homo sapiens
ctcaaaatgtgagcctttcctcagacccagctttgacccacgtactcgcctttcctcaactcattttcatactttcacttgactatatattttttaaaaattgtgttaagcacttgaggttcatttctgcccctactgtatgtgcaccctgtgccagagggtggggtgaacacgtgtgtagcagtcatgcgtcctgtccacaggggccgatgcacctccttgcaaccctttacattccactgtgaaacaaacctcaactttttcttattcctgtttttacaccgtgcttatagctgccttaatccatgttcttcgggatgctggtatccaactgagaagttgacggagcatctatcgtgtgccagacactgtgctaagtgctaacgagaaatcggtgagcaaaacag

SEQ ID NO: 716 - DNA, 435 bp, Homo sapiens
taaacaccctcaaccatagtaatgtatacttcaagataaataattccacatttcctatataaagttgttgaattttgattcaaaaatgcgtaagtattccaataagaaaaactttgtatgtagtgatttctatgtaaaaatattgttattattattatattcaaatggtttatatgttttcattgtcactcagttaagcagccaattctgttagctggtaattccacaaagagaagccatctgccccaggagcaacagaccaagctgccttggtctgagagggtgcatctgtggaactcttgcgcaacttacattttatgtcaccttttgattttactcccaagatactgtgaaaatgttgcacttggaatttatttatggctataacttataatattcattttaataataaagattgtctttgtaattacatag

SEQ ID NO: 717 - DNA, 667 bp, Homo sapiens
aaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagt

SEQ ID NO: 718 - DNA, 474 bp, Homo sapiens
actgaagtccaatttctgggagctcagccagggaatgtgtatttttaaacaagccccctaggttactctgataagtgcaaagtcagagagcgctgctctcatgcactgagcctgagcactcttctattaataaaaaaggagaggagaatcctgggttgggtgcccttcgccttctggcggcagaagagcagagccaggctctaagcacctgcacccaccgctgggctcaggagctgcgctggagaatagaagggctaatttagtcattcatgcctttttagagcaaattacatgtggagagggtggggcacactgaattttattttagccaaatgccccttatctccttatgcaattgatatttttatattgaacattagaggattggtcatttgtcatcaagtcgtctgtaatacagaaaacgataaatacaacctaacagttcaaacatgacgagttaaataaatgatggtt

SEQ ID NO: 719 - DNA, 425 bp, Homo sapiens
gggatttcctgaggacagacaccaagcaatttaaaaactggcctggagagagggaagaggaaacagacctcgtgggtgtttctctgggtcaggcacttggcttctcagtcttgactttgattattcttttgtttttttgagacagggcctccctctttccatttccagcttttagagctgcttctgccttccttggctcctggctttctcacatcttcagattccaaagcgcatcactccagtctgctcgtgtcaccacaagctttcttcccttctccagtcagtcaaatccgtcttctaaggatactgctgatcatctttagggctcacgcctgtagtcctggcactttgagaggacaaagagggaggatcgcttgagcccaggagttgaagaccagggcaacagagtgagatcccatttccac

SEQ ID NO: 720 - DNA, 440 bp, Homo sapiens
cagaaacttccccatagcctccagaaggaacgcagccctgccaacaccttgattttagcccagtgaagcctgtgttggacctctaatctgcagaactgtaagataatagatttgtgtttaagccactaagtttgtggtaatgtgttgtagcaacagaaaactagtattctcaggctagtttttggtcgtctttattttggaaatacttttctagtttaatttgatagttttttttttggaggtactttgctagtctgttttgagtttcagtacataagaataatttttaaaatcttgctaattatatattacttcaaagtcacaaatccctttctaagaatgacttacttcacgagatatttagcactatcattttcccagatgttcatattatttctgcaataaattaaaagggagtgtgtcaaatgctgtcatgtctg

SEQ ID NO: 721 - DNA, 523 bp, Homo sapiens
gtttgagttcactctatcacctaatggcacatttctcagagtgcatccccatggctaactgacgcatgactatggttgcgctcttatatttagttcagaattcagaacctctgcttccctcctgagagccatctctgactgtgccaactcaaaacaactgccccctatttacccacatccctggacctcccctcaggggagtgtctgagtgggcatagggtctgtgcccccagctccctgccctcacccttgcctttctccccaccctcctagaagtgagtgagtgtggaactgcaaggccctgaacggcccagggcagggcattgctttgcctgacttgctgggggccttgggacagccccttgcagagcagggagacttggctgggagatctccaactttccttcccgccctcgcttttggggagtcccatgacttgctgtgtgaccttcagggcgggaggaagggttgagaatctgggtgaggctctcaaggctcaggaaggaaagtacgatcgctgctt

SEQ ID NO: 722 - DNA, 829 bp, Homo sapiens
caggagttagaataaatcccggggcctgggcttctcgattcttggccctccgtagtctccctccgagaggagccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggtttgaagagggagaagttggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 723 - DNA, 392 bp, Homo sapiens
gaggaccacagcgttccatgggcagcaggtgctctactgggagtcagagagcagccaggctgagatggagttcagcgagggcttcctgaaggctcaggccagcctgcggggccagtactggacactccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctg

SEQ ID NO: 724 - DNA, 382 bp, Homo sapiens
tttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtgcagtcaa

SEQ ID NO: 725 - DNA, 400 bp, Homo sapiens
ggcgggcttcagctccctttgcaccaccagcacctcgcctcctgtcagcatgaggcagttttcattttctgcccaggggttccgcagcgccccaacacaaggttggcagaagcgggctcagccggaggacttgtggagggaagttgcttccactgagccagcctcaatctggggtgcacaggcgccaccaggtgaatgcttctgccaggccgtcatctgacccataaggtccctctgtgcactgcttggaaggtcctggcaggctgagccccagccacccacggcagtgacctaataatgcaccgttatcttggctcttctgctctctcttgtttcccactcctgttcgtccctcatttctggtccctagaatgacttccaaaataaactccctgtacac

SEQ ID NO: 726 - DNA, 383 bp, Homo sapiens
agcatggaaaattctaggaaatgaagagacaaaaagagagtatgacctgcagcggtgtggtaggtgcttgtgttgaggagccacagcacatcggcaactcttagaagcacactctgcagccattcctggggagcattttccagcatttgcaccaagtgttattgttgcctttattcctcccctccatcactgtttttaattatgccctattcttagcagtgactattgtgtatccattgagaagttaacaaaactactaggatgtggcttcttgtgaagccttgaaagctactttttataacatttgaaaaatgtttaattacacattactaactaatatgctttatatgtttaaaaactttttattaaaataaatatggatt

SEQ ID NO: 727 - DNA, 810 bp, Homo sapiens
gggactcgccgccatctcaggtctcttggctttgcaggggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatat

SEQ ID NO: 728 - DNA, 450 bp, Homo sapiens
ctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgatggaagctctgaaaataaaagatcttgaaccc

SEQ ID NO: 729 - DNA, 427 bp, Homo sapiens
gcgtggaacaggccctgggttctcctactgggaagaatgaagttcaggtactccatgtgatatatggttccacaatcctcagcgtgttaactgaagccttgttgagtttaacaaagctgccattgaagatctggggaaagtgaagaagttgcaacagagttttgggctcacaccattgatacatttgatccttaaggcccaccccgcctcactcccaccctcttctacttaattcaggatgtgaatagcacatgccttccatcttcagacaaacactgaggcctggacaatgacctgcattaggtagatagaatctactgaaagctaaaagccttttcctgtgtcttagcagcacggaagccacgcctccttccccccaatgtttgtgcaaaccctagagaagaggagacagcccctatgatgtgtg

SEQ ID NO: 730 - DNA, 367 bp, Homo sapiens
gagaaaactgagacccagagagcttaagtgacttcctcgaggtcatagttacttactgccttagtcccaatttgaattcaattctgattccaaataagttgcgcttaaataagacaacagatgtgggaaaaatatgtgaatgtgtagtgttgctatgtgtactgtctttacaagtagctaattattttagcacaaagatgtgcaaagaaaggagactttatggagagttcaggagaaaaaggattttgtggtggccatcactttcattcattttgcgactgctctgatggcacattagatgaagttactgttgatcctgagttacgtgaataagaaaaacaattgaactgcttattaaaaaagtaaa

SEQ ID NO: 731 - DNA, 375 bp, Homo sapiens
gcccacctgggtaatccaggatgatatcatctcaagattcctaacttaattacacctgtaaaatccatttttccaaataaggtcatattcacaagttctgaagactaaggcatggacagatctcattggaaaccatcattcaacccactgcaaagctttagccaattcccagctatgaattcttccaagatgaaaggataccaagctcaagactctcccttgttcatttgaggccttcccaaagatgactgacattttcacaaattttatttggtttcatttcctatcttaacgaaaacaatgataatttcctatcttaatgaaaaaaatgataatgtttatactgtatgataattaaaacatcatgtaaagatt

SEQ ID NO: 732 - DNA, 382 bp, Homo sapiens
gagagtttgtcacttcacggctgcctggctgccatggctccttccatcacatcctcagaagacagcagcccaagccaaagggacaaaaaaagacctctccttggacctattgcttaccagaaagaaaaggtcccaaggcctccactggtctcactggcaaggactgaatcacatgtccatcaggattcacacccctgagcagggctccccgtcccttggacagaattggagttggggtaacaggaaagaaaagggtgttgcacagcgacaagtgcccaccacaggtacccacagcttcttccattgcacctcggaaggcaacaaggagaaaccccatcatttttgagagctttggtgtcattacatttcaataacaaaggtc

SEQ ID NO: 733 - DNA, 408 bp, Homo sapiens
gggctctcaaatccgcccatgcattgagatcttcgctcttcacagaggtgggattagtagcttagtctcagtttcaagtggatgaggttgtgtaatttcaagggaaaattacatccggcaatacctcttttgctaatggaactcaggaaggaaaggccctcagaaaggctggagtctggaatctaggcaggtagctggcctgacagtaaccttgatccaggtaaaccaaagtggaattctcgagcctggaattgatgactcataattgttttcatttaacagctcaggatgtgtgaaaaaaaaatgctgtttaatttgtaagacctaagtttacgactgattttggagaatacatttgtgataatgtatctatgttttcctggggtggcggaggaaatgatttctacc

SEQ ID NO: 734 - DNA, 550 bp, Homo sapiens
tcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactccacctgg

SEQ ID NO: 735 - DNA, 666 bp, Homo sapiens
ggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 736 - DNA, 391 bp, Homo sapiens
gttttctcactgttctcttcacaccatgtcatttcacatggtatattgtaggttttgatgagaaatcggtattttaaatgcactgcaagattggttttaactggagattttgcatatcaatataattttctgatcagttaaattaaaacaaaaagcatacagtgtccacagatgaaaggattaaatcatttagcgttgtttttctctgtttgttaaagaataatcttattaaattcttacacaaagtgtggcaaatataaaatttgcttgaaaatatatcttagaaattaaacttttaatttaattttctacagtatacttatgccacaatgtacgtttccatgcaaaatcttctgtttgtaagtgtgaacattaaacattgcaaaatagt

SEQ ID NO: 737 - DNA, 457 bp, Homo sapiens
tggcctttgagaggtcggtcgggtcctggcacaccgtggggtgggatggggacggatagcaagagccaccattaatgagggcagggcgatccttgaaagatcctggttcaggcctctgggctcactcacaaggggctgctcaggggcaggtgggttgctgcagcccgtgtctcactcagactgccggggtggttgggctcctgtggccacctttgtggggaggggtcaggtcaagatgtccccagtttcttgacttctgacctcatatgttttcccattaagacaaagatttaggctgtggttcacggcagctctttgcaccaatgttggcttgtcattggtgcggctgtgttgggggcagaatcctttgtgggtagcctaggaacctgacccttccagcaagagtttctctgacaacacatgccccctcttgccttaacagtcagtggaaacactt

SEQ ID NO: 738 - DNA, 408 bp, Homo sapiens
aaggtggaatgttctgttttggccaccaggaaatggggtggggtgggcatacacagagaggacccctctcttaatacaactgcttttctcggtgccaaccttccctcccccaagctcagatcctcctcttatgcccttgattgtgccagcccatgccacccccatcctgggcacagttacaccctcccatgcagtgggagaaacacagaccctcatacccaaaggcccctgccccacttctcccccacaaagcggggtctcaagccacactgccctgtttgctgccatgaggcccccccccccagcaatatcccaggggcgggcccaatgcccactgtacatgaggctgcatgatgggtctggggccttgctgattccccagacccctaattaaatgtttcttgtccc

SEQ ID NO: 739 - DNA, 383 bp, Homo sapiens
gccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtg

SEQ ID NO: 740 - DNA, 351 bp, Homo sapiens
acactccatctctgttcctgccggtcgggtccgcaaacaccggggatcccagctgcggcgcccaaagggttaacgcaggcgttcggccagtgcaaaccggcctcgcaggatccgcgcttaaaatccgggtgttttcattttgggtttgtttcttctactatgccaagctggtggctctcttttaattctcttgtaacatctcaaccctgcacccatctttcctgaggggaaaaggaaacgggataacttgcggtatttcgatgctcaaaggtaaccggcggctctgctccaaccttcaagagattttgcaagttgaaaaaaaaaaaaaaccatccttcgtaacatctactt

SEQ ID NO: 741 - DNA, 505 bp, Homo sapiens
gctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaat

SEQ ID NO: 742 - DNA, 484 bp, Homo sapiens
ataaactctcattgagcttctggtctacgtcaggctctgtgcaggaccttggtgatggggactacaccaccatcgtccccgccctcaaagagctcaaagtctagtgatgagcagaccccctttctcccaaaagtaacagagaggcaaagtgatagggctatgcaacagaaatgtggaagtgcagccacaggcctttaaatgtatgtagtgctgatattctgaataagttatatatgcacacagtacacacttcacagggcacaaaagggtatggaatgaaaaggaattctccctcccaccctgtctctcagctcataaattcctcttcctgggtcaaatacagttgccagtttcttgtgtgtccttctggatatattctctgcctatatattcctttaaaacacacacattgtatagacgttatacacacagttttgtctcttacttttttcacttatagaatatatgttgatgtttttatgtc

SEQ ID NO: 743 - DNA, 426 bp, Homo sapiens
gtgtctggtgctcggcgttggaggctcagcccacactgtgccgggcagtcgcaggcctcccagatgaatgaagcatgagtgaatcccgatcctgttatcacagcttctccctacgcatcccaggcagaatgttgtgcaaaaaccacaccaggattcgtacatgccagaggactgaacttctgcgtgttgcagataattcatcttcctgaatcactgcggatctaccatggtggttaaccacagaataaacataggggagagcgtaagcgctgtcctaacagaaacttatgcttcttccgttaccctttaaaagtaaagggtactgatttcataattgtgtttctcttgtaaatgagactctcatggaaaaatcagccatgtaggcgatagatttgtatacctttagattaaaatgtcacttcgatt

SEQ ID NO: 744 - DNA, 468 bp, Homo sapiens
gctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcaagaccaggagagggccacctcactgggcctgcctcccccacctcctgggcctctctgacctcagctcctagaccctggacccttggctgggactcagcattttccagtctttttcaggggtagacaggggagcctgggttaaactttaccactgtgccctggcccaggcatcaccaacacggcctccctgcagctgccctgccaccgacagaccccgattaaacccacacctggccttggcctcccctgctctatgccttgcatggtttttgcctcacttggaataaaattcca

SEQ ID NO: 745 - DNA, 570 bp, Homo sapiens
gcagtgaatgtgccactgtatgtcaacctcatgaagaatgaagaggtcttggtatcagcctatgccaatgatgtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgca

SEQ ID NO: 746 - DNA, 407 bp, Homo sapiens
aaaaacggaaatgtataaacatgtcaaaaagaactgttgatgctttctaacatttgtataaatagaattcagtgcaagttacaaaaattctgttgcaccactctagttttagtatttctattttaatacatttgtttaccacttgtttatgtatatgtaggtgatgttacttgagcttaaatgtactttactgagcaaagtttaaaaaacaaagtatattttattttatgataaagggcctttaacctcatggtcaaatactaatattatatttgctgagacaagatttgaaattgtatcaagagttttatttttctgacatttaaagttctacataataaaggtaaaacttaagtaatggtgctacttcattttttaagtatttctatataaataaaatattgaag

SEQ ID NO: 747 - DNA, 439 bp, Homo sapiens
gcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatcca

SEQ ID NO: 748 - DNA, 428 bp, Homo sapiens
ccgccttcggctgggtgggccatttgcagctgtttggagaccggtcgtctttatcccctatatgctaggcctgcgtctcaggtgaccgtgactcctgaagcttttcagcgcaggtgtagccggcttggcgtcgccgcagtgaggtttggagccgctttggattgctgagtcactttcttcagccacttagggaaaccgaaagtggaaactcgtggggcttgaaatagtgtgttctcttgagaaccaccgaggcagtgagatttgggattccggggtctggagatcgtgctttttgtggactgcgtttgcagttcctagggtgctgctgattcacaggccttctctgtctttaagtgtgcagatcattgaccgctcagtttaagagtcactggaaatcctgtcggaacagaactaataaaaatggtctg

SEQ ID NO: 749 - DNA, 458 bp, Homo sapiens
aaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcaccaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaattttaaaaatc

SEQ ID NO: 750 - DNA, 454 bp, Homo sapiens
agctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctct

SEQ ID NO: 751 - DNA, 492 bp, Homo sapiens
agccaagctgtgctgcgacacactatcagggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtaattgctggaatccacaaataccaaactatggccattgaagctgaccttggagggggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttactt

SEQ ID NO: 752 - DNA, 413 bp, Homo sapiens
gatgacagggaaaagattgtctaaagagggcttgaaattggggaaataattgaggctcagtgacaaaggagaagattacaacttcaaaaatgaataaataaataacattgcatgtttattttacaacaccagggggcgatgatgtctacgtttttattctgtatcctttatcgctgacaaagatttggtctctgcaattttaccttattgtttctcagatgaccaaggggttggcttaatttgttctgtttaaacttattgcaagtccttctgtaatttcctaatgttttcataatgtgtgttgtgaccagactctccttataaccccagttaataaaagttaacaggaaaaaaaaaaaatagaaggattggaagataaagttggggaaatttctctgaaagtaaaacaaaaa

SEQ ID NO: 753 - DNA, 542 bp, Homo sapiens
aagccatttacttcttagattggaaactagagcctggtttttgaaataaagcttggcagtatctcacttataacttactttataaaatgtgtaccttttatttgctgtcagagttatctacatgaatttgagatgtttggataaatcgttattggggaaagttgcaattggaaaatagacaatgaagtctgggcagagttccccacccttcggaaaagagtctcggatggtataatccgcttggagaagtctaagggagaaagaaggggggaaatcataaatgctgaaagcaaagcaaagacagctaatattaggaaacagaacatgggaatccagtccttcttacattgtactcctggttccgccagtgttctcatgagtgaccttggatgaatccttcagtgtcctgtgcatgcttccccacttaaaatgagaggattgaatcatgtgaaattctttttttaagcctcctttctagaaaaaaatgaaatgcttttcaactctaatttagtgattttgattcaaatataccatgtataacc

SEQ ID NO: 754 - DNA, 448 bp, Homo sapiens
agccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcttactatgaggccgcggtccgggcgggccgcctgcaactcaacgagaagccggtgcaggacctcaacatcgtgctcaaggtggagtcctgatggggctggccagaagcgggcgaggaaaaggggccgggttttgttttgttttgttttgttttttagtcttagtaaagcataggtactggattaaaatcatggcaa

SEQ ID NO: 755 - DNA, 420 bp, Homo sapiens
ttcctcccaccttggaggtttcttcatcactttttcttttccctccagtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgccaagagtcaaccactaagcaatcccacccaagcctggatgcttctagaggggcccactcccagctgggagagtgtaggggatatgctcacaccacattagcagcaaccaataaaaatgctgg

SEQ ID NO: 756 - DNA, 376 bp, Homo sapiens
gggtaattaacatgagttttggggtccagcagcagaattcaggtttcctcttccactcagtaacctcagcatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggtgtgtagggatgcctcagtcgcttacatgttgattgagtgaatcgtcggtttctttctggacactgacttcaaaaataaaataggatatgaaaatgg

SEQ ID NO: 757 - DNA, 1698 bp, Homo sapiens
gagatggagtcttgctctgtcgcccaggctggagtgcagtggcgcgatcttggctcactgcaagctccgcctcccaggttcacaccattctcctgccgcagcctcccaagtagctgggactacaggcgcctgccactgcgcccggctaatttttttttcgtatttttagtagagacggggtttcaccgcggtctcgatctcctgacctcgtgatccgctcgcctcggcctcccaaagtgctgggattacaggtgtgagccactgcacctagccagaacatcgttaatgtagttcaatatgagataaattattatcttcaatgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaatttttttttttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactg

SEQ ID NO: 758 - DNA, 355 bp, Homo sapiens
atcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatc

SEQ ID NO: 759 - DNA, 379 bp, Homo sapiens
tggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgcaat

SEQ ID NO: 760 - DNA, 486 bp, Homo sapiens
gtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacat

SEQ ID NO: 761 - DNA, 358 bp, Homo sapiens
gcccgaagttgctggagccggagttggaagagggtcatttgcatgtgctaggagctgtcttccctgttcagaatgaaattggttaggacagagaaccgtgtctgagctaaccaagtggaacagaattccctatggtcaaattaagtgatctctttatttcgccatcctgattgaataatcttatcattttaaatagagaaggtctccaaggaatgtaaataatatgaatgcccacggatttgtatttactgagcgtctccttctccttctcttggcatataaaacacagcaaggagcggcaaggttagctcaaatgttaacgctatcaattttcttctgttaaatgccctgggggagg

SEQ ID NO: 762 - DNA, 400 bp, Homo sapiens
gagtccaataggaagtccgggagtgccttcagttttcactcaaagcaggcccttttttcgttccttccctgttaggggaagatacacctggacgagaatatatcctcacctcaccaccctgaaaagctgctttctcccttgcatccatatcctctcttcctgtcacctccccatacagcttcacatttgcctcatcgcacttttcttttctgtccacctttcataatcccatccactccaaatcccggaccctgcacacgccaactccctgaatccaattcaggagtgccccagttcccctttcgatccatctcctttctactgtagcggagactacaagtcccaggatgccccgctagcccgtgaccggctaggaaataaagagccttctctccgcggt

SEQ ID NO: 763 - DNA, 444 bp, Homo sapiens
taggaggaggtcatattgagagtttgtcatctcgtagaataatcagtatgagattagaaaaggtagaggttttttggattagaggcagtttagaaattgtgtgactggcttattattaatcgaattagcagtttctgttttctggtttccccatcatttcacctgctactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacacc

SEQ ID NO: 764 - DNA, 350 bp, Homo sapiens
atgctatatcattattttaatattgtactgaacattttacaaaggtgtttcaccataaggcatattgatctgtaatttttttttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatatt

SEQ ID NO: 765 - DNA, 490 bp, Homo sapiens
tttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatg

SEQ ID NO: 766 - DNA, 503 bp, Homo sapiens
taagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattattt

SEQ ID NO: 767 - DNA, 1247 bp, Homo sapiens
agtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatccgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttc

SEQ ID NO: 768 - DNA, 426 bp, Homo sapiens
cccatatgctaggtagtgtagcatctgcccacctacacacacacacatgcataggtacacgcacgcacagacgctgtcccttctgaagctcagtgtccatcctgagccaccccacagatctctctccggccccctagaagccctctcctcactgcagccctggtgctctggggaaggaggggcattgacaggtggtttgactgttcacccagcagccccgcttccccactggtttctctcctggctgccggcggaggtaggctgggaaagcttccccctcacactagggccggcacagccccgccccgggccccagaggtcccctgcatcccccttctttgccttgcctgggttctcaggcagggcccctgctgtgtccgtggtgctgttgtattggtcactaacggaataaagagttaatatctc

SEQ ID NO: 769 - DNA, 470 bp, Homo sapiens
cagctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagt

SEQ ID NO: 770 - DNA, 430 bp, Homo sapiens
tttgttctggggcctgccctatgcattgtaggattaatgtttagcagcatccttggcctctgctaacttcttctcccctccccagttgtgacaataaacttgttgttcagacattgccaaatgttccaggggggcagggataaacctcctagggttgagaacctttatgtagtaaaatttcaccattcaaatgttccatgagagaatctaaattaaagattagaaagtaagtaaccacttcatgggggaagagttccttagcttctgggccactcccacccccatggcaccttgtgcttttccctgtcagagcactccacatacatattataaaggtgtctgtctattgttctcctggaggattgggactatataatcattgtatccattgtgtctagcaagtactcaataaattatatatttttgaatg

SEQ ID NO: 771 - DNA, 417 bp, Homo sapiens
gctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgg

SEQ ID NO: 772 - DNA, 352 bp, Homo sapiens
ttgaaagagtatataaacatagacatactgtgtttgccttttttaaaaaaagggctgtttaaatgggtcctaagataactttttgataatgtaatattgacatgataaaattgtaaacttcataattctggcacaggaacaatttatgaaaacatactaaggtatttgtaaattgatgaaataatatatatcttaggaaagtcataattattacacttgtacatacccttaaaataaaagagcctgcttgaaatgttgcaaaaagaaacagaaatacctgctaatatgcccttctaattaaggatgatgccaattaatctctttatataaataataaactttgagttgtttt

SEQ ID NO: 773 - DNA, 413 bp, Homo sapiens
tactgccatctttctgtctgcactgtttaattaggcttactgataacaactttaattctgaattttctttctcattcaggttctatttgtaattactaagacttaaagaatagtctggtgaaattactcaaagaattaaggaaggtttgagctaaaatgaactagagaccatctagtactttagtgtaaaatatgtttaatacaagtcgttaagtccttgtaagtgactattccaatgtttattctttgtttttggaagaatgcttggagttaccatgtttttaaatgtgaaatttcatctaaattaaaaaaaaaatctctgtgatgaggctgactcacccatttggtcaagattagtgctagctgatttgctgaacctttgcctacagaattaaagtactttctcaagtttt

SEQ ID NO: 774 - DNA, 468 bp, Homo sapiens
cagatctctcagccataactagctatctgaccttggccaagtatgctcaaagtcacaaaaccttagtttccttatgtgcatgatgattataataccttttgtacagttatgaggaaacttagacaatgcctgtgttgtatggtaagcgttttcataaatgctgcctacctgtaagtagcattatagtgtgtagttattggttaatttcctttttctttaccagaagtgtgggttttgcccagcctttatacaacttcagtatttctggttaatctgtctctctatggctctaaacttttcagagtggtgggggagttaccaacacttttgtaaaaggccagatagtaaatgttttatgctttatgtagtctctgttgcaagtactcaattctgtaattatagcgtgaaagcggccacagacttgtaaatgaatgagtacagctatgttctaataaaatttttatttac

SEQ ID NO: 775 - DNA, 415 bp, Homo sapiens
tgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgt

SEQ ID NO: 776 - DNA, 711 bp, Homo sapiens
actcggagcagttccgatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctc

SEQ ID NO: 777 - DNA, 475 bp, Homo sapiens
ggggccgcgctctgagtccctggaccagcggcagacccatcacccatgacgcctgctccctgcagctgggctctcagttcataggaacgccctgcagaggggccgccacgcagctttccagggagcaccgtccaaaggggctgtgctgtgtacctgggggggccagtgctcgagctgggacactgctctccacccagtcctatcagccccaacgaggcccttctggaaaacctgccctctgatacctctaatcacgttatgtctggagtccccttctggggctcttccagcaaaaggccatcctctggggcgtctgagagcagaacctcagccaagggggccacagtaccctcaaaaaccactaaaccactgatacaggctctctggagcagggacactgtgcccccaggtgccagaggacagagacaggatccaccctgggccagccataaacatgcccaactcaacggtggcg

SEQ ID NO: 778 - DNA, 498 bp, Homo sapiens
gtaacagttgaaataactcataatttaaacacttggtgagttttgctcttttctgtcttgagtatgttatgaaacacggccatgtttttctatttaattattttttacttttccttattgtgatgatacattatagcgttccagctgacaatgtatttttgtgtataatcgcccatttcgcccatatttcgacagtagaatagggaagacaaccctattcttaaggtacccttagcaatcttcactcatttttgaagtcctcaatctcgttttactaatgaatagtgacccagagttacatggtaatcaatggctacattagttactatccattaattactattttgatttcttggcattttagtaagcaatgtttggatcaaaacagtttttaagtttcaatctaagtctgctccagggagataatgggctgttcttttgggtgagagctgctgctttgacaattgtatttcttataaataaatttaataaattagt

SEQ ID NO: 779 - DNA, 412 bp, Homo sapiens
acaattttttttttttaacggctttttggttttctcttcctgactcttgtcaaagaatttcttgctcttgagggaaagccatgggagagtgaaacaaagaaaattagtagaaggcactgaatgccaaaaatgtcttcttacatataattataatcaattatttcccattattgtcaatatccttccctaggatgtatcttgactgggaaaaaaagtaacttggaagagctaaagcagtatagatttgccatgctgattattttaaatgtaaccagaatggcttttgggaatgccaaatttttataaggtgcagtagacagatagaacccaaggataaaaactttcacatggttctttcagatttgatgtgcattcattaataaagttgtcagaacccattgtatcaaaccat

SEQ ID NO: 780 - DNA, 496 bp, Homo sapiens
tttgaagctgttgattaccaacaaaaaagtttcactctctttatagtgcttcaggatacaactttttcagggccttattagagaaaaactgattcacatgttattcttctaaagctaaattattacaatgtaggttgaaagattggattgattgtgaatctacactaaagatatggttccaggcagacctccttagagacctccaggcagacctccttactgtcttcagtgatgtttaatttcattactgttactgggtgccaagtgtctttcatttggaagtgaacttactccagttattgaatgtttatcatatcataatttgcatttttccaacattgaaggtattttaaaaagtcactaagagattcattcttttattattcaactacaaaaaaatagtgtaatgatcagaatttaaaatgtgtgattctttttcttctgtaagtatgtattgctatgataaataaaaaatggcaggaccattgtttttatt

SEQ ID NO: 781 - DNA, 453 bp, Homo sapiens
aatgagctgttttgtgatttaaaggtttaaatttctctaaccaaactgcttgatccagatgcaggactgcaaatgttaatatttgttctggaagaacaatcaaataagacttaagaggaaaaggaatggccacaatccacctgaaatttttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaacaagtcttttgaatttatgcatggtagtaaacattctctctattaactttattacctaaggctaaacctaaaatttttaagcaaaattagaaaaatagtcttcactcatcaaaaaataaagtttgttacatttagtattttcccaat

SEQ ID NO: 782 - DNA, 780 bp, Homo sapiens
acttttttattcataaaaaatccatcaaaacaaaaaagttttccagccacacacaggaggggtatgggtgggggaaggtgtctgtccatctatccctggcccccagcccatgtggttttggcagcaataaggtgtgtggagtaatgactcctgaaattaaaatggtgtgtgtatgtgaaggaaaggcgggcaaagctttggggagacgtggagtggaaggaacaaaggaggtcagtactgggaacgctgaaggttggaggccatttcataacattacttgttgatgaaattgccatggataccttctttgcccatcagcaggcctagcgtcttggcagtcatggtgacaatgacgttgaaggtgggggctccaccgatgctcttcatacaaagatccgtggtcaattccccatcctgcagcagtgagtccaggaccacagtatatttctggccccccagtgtcagcccattcatgacaaagcttgaccagtctttgccaaccaggacaccaacctcagctggcgtgatgttgaggaaggttttccctgggacggtggcacagatggaaggtgggtccttgttgcccacaatggccgtgtcctaacaggtcccgtccgccacgaggctgtagatggaggtgtccacctggcctttgcgttgctgcaggggctcctctggtcgctgctgctggggccgcctgggctggcgggtgggggaggcggagagctcgatgcaggtgctgtcctcctcgccacgactctgctagctgtgcagtagccc

SEQ ID NO: 783 - DNA, 423 bp, Homo sapiens
gtcgcaatctgagaggcccggcagccctgttattgtttggctccacatttacatttctgcctcttgcagcagcatttccggtttctttttgccggagcagctcactattcacccgatgagaggggaggagagagagagaaaatgtcctttaggccggttcctcttacttggcagagggaggctgctattctccgcctgcatttctttttctggattacttagttatggcctttgcaaaggcaggggtatttgttttgatgcaaacctcaatccctccccttctttgaatggtgtgccccaccccgcgggtcgcctgcaacctaggcggacgctaccatggcgtgagacagggagggaaagaagtgtgcagaaggcaagcccggaggtattttcaagaatgagtatatctcatcttcccggagg

SEQ ID NO: 784 - DNA, 521 bp, Homo sapiens
ccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatcatttgtctctgtagattattttataaactgagagctgcctgaatcttctcacattgacaaagtaatttgattccaagtttaagactagttttcagtttgatattttcatgttttgtgtgcttatggttaaataaatgttgaaagatattttcaagtttacttagaaattttaaattgt

SEQ ID NO: 785 - DNA, 399 bp, Homo sapiens
atttatgctctctaggacagacatggtggttctgattgcctgggagatagcccaaatgcctacagcctctctggcagaacccctagctttccccagcaacctgcttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataata

SEQ ID NO: 786 - DNA, 388 bp, Homo sapiens
tctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagattttaacagggtagtgtggtgggtactttttaactgtttgcttaaagtgtttcaaagtaaaaatatttcttaagcat

SEQ ID NO: 787 - DNA, 382 bp, Homo sapiens
ctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttttgtttttttaaaaatatttttatgtgttcaaactattttggtaaatttttagc

SEQ ID NO: 788 - DNA, 410 bp, Homo sapiens
aatttagtagtataaaatattgttgtccatatgttaaaatctatatgccaccactaattttttatccatgaatactgggtggcaaaattaagcacctacaaatttaaaatattttctaaatgttaagaactttctgtcattaaatagtattttgggataaattttctagaatattctattacatcctctttactaagcatggtactaggtaggtaattagagaatatgagcaagattcatgttatttatttttaataaagcaggtattgctgtctctaagccagatctggtcacctgtctggagcaaggaaaagatccctggaatatgaagggacacagtacggtagtcaaacccccaagtaggtgagagtgaatgaaacagttgacatagacgaaaggttgaaagattt

SEQ ID NO: 789 - DNA, 473 bp, Homo sapiens
gggcccaccctcctgcccagctctgtgtctggcacctgtgcctccttccttcacacccactttggtgaccctcacggctgcttgtccccttgaggtactgacactcacttcccagggagggtgcccaaccttctgccctaattgagggcagggctatccccgctcaagcaggacactggaatgaaagaactgtggcccattttgctaggattgtttttgctgttatatgggttggtattttcaggaattttcaaggacggggacagaggtcatctttctttatcctgagattctactgatacgctcaacttgcaaaagagtcattgtgagtgtgtgacagtccttttgtgtggatccccaaagaaagcaaggtgttgccagttcctttctcctgcaggattttttttttctatcagtgaaatattattaaaatgtcttaacatttgtttagtgccctatattttataaataac

SEQ ID NO: 790 - DNA, 358 bp, Homo sapiens
cttgactttccttttctcagagttatagttctccagagatgtcaccagatgattcacattaaaggtacatttccagttgacttttttatttcagatattagtaaatgattaccagagaactaattcaaactgtcatggttggaaatactctgatgctcaactccctaatctatagagtgagttaaggtctatactcttttgcaagcattgttctagtggcagtgaccctgttcatgattcagcctgacatttactatgctgccctgaaaaccaactagatgggagcttgtttctctctgcattgtgtagtgagtggtgtcacccaggactttcatgtgagaaaaagcaccttgctttt

SEQ ID NO: 791 - DNA, 610 bp, Homo sapiens
gcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaagtgtttgaaatcattcatatttgaaatttttatcattagcttaaaaattactctcagtattgtt

SEQ ID NO: 792 - DNA, 442 bp, Homo sapiens
gcattatgagtattagaaagtctgcaaattaggttgtttgctttgtggtgaggtgtgaaacaggatatgcatttttgaaaatgtatctttggatttgctgaactgggctcaaatgtggtcaaattgagagagcttatgatgccagttttactgcattctttttagttgtgttccccaaaatcctgccccatgacctttaccagaacaagtaaacacatcctaaaaacaaagttatgttctagtatggttttaaaagtcttcccttttggttatttggaaaatagtgcaaacgtgcggtctagtggttatggccaaaggcagagcaaagggagtgcggccttagccagccccagccagctgccattgctcccacgctctgtgtggtcttgacccaatgcccagaaaagcaaggttccccactttctacctctttatttttaaa

SEQ ID NO: 793 - DNA, 399 bp, Homo sapiens
ggaaagtgctgaggctttttgcaggcgcagttagcaggcgaactggtcagcagggtttctggggaacgtagatttgcgtgacaggggccctgtgttgctaaggaattaatgcaggcactgagaaaagtctcagcgtcagacactcctccacctcccgggtcctgcttccctccctctcccctttccaggcaactcacagtttaggggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaaaaataaaagaataaagaataaaaagaataccactactactat

SEQ ID NO: 794 - DNA, 399 bp, Homo sapiens
gctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccaccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggc

SEQ ID NO: 795 - DNA, 517 bp, Homo sapiens
tttaggtatacatgatcgtctgagtggtcataaccttttcttttatcatgtctcgctaataaccccagctattgtctgttgtgttcagctgagatgcaaaaaagaaattaagcaaaaaagaaaaaggtgaagacttttcatgaattttgtgaacttgccaaaaggggaagggaaaaatctttgtgttacttcactcaaagaacataagtaactgcaattaacatatatgaaatttattactctgcttgcatttatgaaactaaccagttttttaaactttaattcttaaatttgtggttggaaatgctgataatttattttgttatttaagagctgttgttaagtggaggaaagtagttgttaataaatgtataaaactgttcttgactagtaatcagggacaaaatttatagttcataagtcatgacacagtattcgctctttttctgaatgtttacatagagattcatcactgcagattacagaaagttaagtgtatactacaaactctaattaa

SEQ ID NO: 796 - DNA, 903 bp, Homo sapiens
caactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggct

SEQ ID NO: 797 - DNA, 403 bp, Homo sapiens
gatttttcgcaagaatttcgagattttaaaaatagagtcggggaacaggagtttgaagcttggggagttggaatgtcactagagaacaaaaggccggaaatgtttccatgataaaaaatggttaaagaaaaatcccaggagttctgttgtcttgaaagtcatagaaacaacttaaaagtagaaaatggttaggtgttacggctttctcgtcgttttgcttccgtatgttaaacatacagcactcaccaacgttgaaatgggcattttccgctgttggaacagcaaatctgttaatttcaagttgctccagagaaaacctgagctgtccctttaaggggttctgcttttcctatttgtgttggcatttgaaagattgtggaggcagaaaactttctggaatgtc

SEQ ID NO: 798 - DNA, 542 bp, Homo sapiens
agtgcgttccggggctttcggagcagcggtgtgaggaccagcagagagaagagattccatcttccagagtaccctgatgggaggatgaaaacagcagaaaggagcagcaccagatgatcttttcatgggcacgtactctttcaaggaatcccatggagctcagtgaaattacactttggcttagagataattaagttgtggaaggaggtttaagagaggagcttaggtgaaatttgagctgtaaatgagtatgctaaattaaagaaatgattagtaataaatgagatttgctattaagaaattcactttggatctgagacaacattttacatacaatgtagaaaactttatggtcagaacagaacacagtctgaacctaaattaacagtagtgttaaagaattcagggcgggatattatccaagaaggcctagccagctgctccacttaatgttacatcacaagtggtttctgtgttgctattgtttttattagcatttcaatgactgtgtcatattacattaaatcaattggctctaactt

SEQ ID NO: 799 - DNA, 373 bp, Homo sapiens
cttgtacatctctcacataaaccgcataggcagggcttaactacaggctggcccgagtctgcactgagtctgaccctgaagttcctttggaacaggagaggccatcttgtgatgggctggaacaaggtaatttctcatccacctccctagtttcagttgagcaatggaacttcccacctgagcccctagggttcagctacaggctataagactgccgtcctgtggtttagtgttggttccttagcagcagagtgatgccacctctgctgcccgtcatctgactcctctggatgggtgttatcctgtggcttaagagctaacaccatgctgatcttgctttgctatatgtgtaactaataaactgcctaaatgc

SEQ ID NO: 800 - DNA, 436 bp, Homo sapiens
ctgggtccaggcctcagacacggagaagctgctctggtgacctagacgggtcgggggatcctggcggcttaggggactggttgctggaagtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgc

SEQ ID NO: 801 - DNA, 350 bp, Homo sapiens
tatcaagagcctctggtaaccactgttctactcaatacttctatgaggtgaacttctttggattccacatatgatcaagatcatgaggaaggaggagcaagtcttctttgtcatgctattaagaaaatacccagagtcacagcaccatgatctccttgtgaagcagaacaagtaatataaaactgatctaaagaggcctcccctctactcttatctgtctggtcgagtcatttgggtccaagtgggcaccattgtgggagggtgggaggactcatcactgggggcccaggcatcattggcatgtggcctcctgtgttagtttgttctcatgctgcaaataaagacaactt

SEQ ID NO: 802 - DNA, 1075 bp, Homo sapiens
agagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 803 - DNA, 498 bp, Homo sapiens
gaaatgtggagagaaagtaatttgaccacttgcttgccctttgctgttccccatcatcaaccactgtcttcaacagcggagggtcccagatgctgcagggagggggagaactgcagggagttcaaataaaacattcacatttcacttcacacacactgtcccttagactttctcttcctatttaagcacatacatccaaccacactcaatcaaatccctgactgctccatgtgagagttctgcttccagcatgacgtggtctgaaagttcatctgaagacagctgctcactcccgggggctaacaccgccccttgcatgctgatgtccttgtagtcattggtctgatgccacaataaataattcctaaggctgatgctctatttctgccctgagactctcccctttttctccaagctgtgccccattccttgtcttagtccaggttccctacactccccaggccaatgcttttgaataaatcttgacgtcattgaatg

SEQ ID NO: 804 - DNA, 988 bp, Homo sapiens
tcaggcctcacattttcacacacaccagagagtccacactggagagaggccttacatatgtgatgtctgttgtaagggcttcagtcagaggtcacatctcatctaccatcagagagtccacactggagggaatctgtagaaatgagaggtgtggttcagccttcagttagagctcacatctttgtctccgttgggaagtccatgctgatgattgtgaaaagttcctttaaaactagaagcttcaaagaatcttgacaggaaagaagtctctcaaatgctgtgttttagacttggttaggacatgaattctttacaaacgtcatatttcacagatgcgagaaaactttgttctgtaaatatgatcagtgtttatatcagagtaccaggtgtcccggttctcaagatgtaacacagcagaaaagtcttgtcggagtctgcacaggagagaggccttcctttaacaaaagtatgattgacagaaaaaatggatgtcaactaaaatgtaacctctatgtaaggaggtgtttttcaccactctatctctaccatgtagaattgtgcttggctcataatagggcccagcaattactgaagaaagtgaagaaaatacctataattaggacaaatacttgaaaattctagtctgttttctactctaaatttatattaatttatattcaaaaggaatcctgcaagtagccttaataacgttagtttcagtaagtactgaaaagtatataatactgccatccatactaacacaaatttggaaaaaagacatgaatggctcccatccttcagccttagttctttgtacagtgtatcatcagttgtgtacagtatgatttttagtgtcagtttatagactgaacaatactgtttttatctaatgtgaccctgcaatttacatgattagaatttttggacactaagctgtactgtaactctgaaagtgttaaaagtagttactgatgacaaaaagtttctt

SEQ ID NO: 805 - DNA, 421 bp, Homo sapiens
agtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtc

SEQ ID NO: 806 - DNA, 371 bp, Homo sapiens
ctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttct

SEQ ID NO: 807 - DNA, 461 bp, Homo sapiens
cttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttac

SEQ ID NO: 808 - DNA, 440 bp, Homo sapiens
cagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttca

SEQ ID NO: 809 - DNA, 440 bp, Homo sapiens
tgccagctccaggcagggaggctgagaactggctttcagcctggggaggagtttggaggattcgggagggagaggtttgtggggttggtggtggcgagagaagaggacaggaggaaggagagtgtgaagggaggcaaggggctgtgggcagaggggaaaggaaggtggcctcgggtgaggggatactcagagactactcagctgcctgggccaggcccctctgcagataagtgtggctggggtggtggtatgcagggctgtgtggggctcccagctgactggctgcgtctgtagcagccccactattcctgccctgggcctcaaaccaggagcgtcccaggccttaggtcagctaaccaaggcccgacattgctggcaggggtctgcaggggtttctgtggatactttgacatttttcacaataaacatcctctgttttg

SEQ ID NO: 810 - DNA, 1215 bp, Homo sapiens
ggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaaggaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacagg

SEQ ID NO: 811 - DNA, 340 bp, Homo sapiens
gaggaatcccccaagagaaccagccattccaaacttccggagcaggaggctgccgaggcagatttatccaatatggaaagggtatctctctcgacggcagacccccaaggagtgacctatgttgagctaagcaccagcgccctgtttgaggcagcttcagaccccacccaggagcccccaggatttcatgaatatgcggcactgaaagtgtagcaaaaagacagccctggccactaaaggaggggggatcgtgctggccaaggttatcggaaatctggagatgcagatactgtgtttccttgctcttcgtccatatcaataaaattaagtttctcgtctt

SEQ ID NO: 812 - DNA, 1148 bp, Homo sapiens
aatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaaaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttacttgagcattggttgattaaagtttaggtaccatccaggctggtctagagaagtctttggagttaaccatgctctttttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttacatttaaaaaaaaagttaaactaaacttctttactgctgatatgtttcctgtattctagaaaaatttttacactttcacattatttttgtacactttccccatgttaagggatgatggcttttataaatgtgtattcattaaatgttactttaaaa

SEQ ID NO: 813 - DNA, 371 bp, Homo sapiens
actccggagaagagggagcaagaggctgcctttacccatcatttcttttccctgtcactacctgttagtaatgttaaagacaggtcctctggttaaaacggtttctgtagaaagaggatgatcaattttaatttcctttcccaacatgggctttgattttctgttttcaaaaacaggatacacagtgagaaatgctgggcgctccccactttgtgacctcatctacgatgagttatgacgggttaattataactgcagggaattatgcttatatcataggagattgatattttctgtgaggaaattagaaagctgttaggaaggcccagaacatgcagaaagaaaaaaaaaacctcctttgaggcagagtt

SEQ ID NO: 814 - DNA, 438 bp, Homo sapiens
atgctgctttggttcaagacgtaggagcagcaataatagagggctggtgatggctccctcttggcattcagtatagtgtagatctaccacgtaattaattctctgtttctttgaggagctgtgaaaccaagggacatatacaactgctcttttctccctgtttctacctgcagctttgtcctaaatgtgagacaattatgaaaagtgcagggcagagccacttgggtaaatacagccccggctttctgctcaggggacagagtttgaggcactgcagaggaaccagccaaagtatgagacccatatgttgagagtgacagtgtaaagttcaaaaaaatcaaaatgtttaaagatttatcatgggtcttgatgacatgatggaatctctctactctctggactgattatgtgtggtaataaatttactttttaaaagcc

SEQ ID NO: 815 - DNA, 502 bp, Homo sapiens
cacccaggtctggccgactgtaaggctgcccaccatgacaccagctgcaatgtttccatcctcgtccactgttgtggcatattggggcatgtcctcaaatactccagtctctcctaccctgccccctttgaagtcaggggaggctgcgtggcctctgtggcaatgcaaagtgagctgaagtgacgcagtacttcccggcagaagctttttcttgccatggtgagtgaggaagcacgtgctgcaatacaaactccatcagcggggggcgtggtggccacagcaagaaaaaccttcctgctaaccccactggatgcacagcatgggggagaaatgaatatatactgttaagaccgtgggcattcggggctctttgttactgcagcatacgctagccaccctgactgatataatgctgtcatttgccacatgatgtatgtgatctcctgtcccatccctgatcttcccactcagaaaggctcattgccattgctcccgttttaca

SEQ ID NO: 816 - DNA, 452 bp, Homo sapiens
ccaaactgtcatctcagcaaagaagtaaggctgaaacctggggttattggaaagtaattctaatctgctttgaccattgacctgggaatgtcctgaaagatttatgtgattttgtggaatgtttcatttacattcagtggaagtagctcttcttcccaaccgtgaatttgggaaataaggtaacagtttgtctactagttgtccttcctctataagtatttctggaatagtgctgaaaagcttaacaaaaatctagttgttaaaaaatgtgattatgttgaaaataccaactttttagaattatttatgacatcatccatatatgatttaaatcgtgaatattacgacatttgtaatgctttaccagttacagagtgctttcatttactgttacataatttgaaatcagctcttggagatgaaatgattctctaagtcattgtggtgtctgg

SEQ ID NO: 817 - DNA, 1146 bp, Homo sapiens
gatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccagcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtaggacttgggagtcattgggaaaaaaaaataataaattttccccttcatt

SEQ ID NO: 818 - DNA, 374 bp, Homo sapiens
gcaggaaaagaaggtagaggggatattcactgagcccccgcctcgagcctgggcccgacctggggtgtttgccttactggccgctccagccagtgtgagaggctgcactatcatgcaccccactgacaggtgaggaaggcgctgtgaccaccagaggagtgagcagactggaatttgagcccaggtctgctcagctcctacacccggcactgagcttccggtctgacctggctcttgggcagggccctgcaggccgcctccctatgtggccccagagtccagagagcagcaaggagagtaggtttctacggtgacctgggcaaatgaagacactaacctgtgcctcagtttccccagcccttcccactcacagc

SEQ ID NO: 819 - DNA, 458 bp, Homo sapiens
gattccatctgtggattattttattagacatgccttctgaaagattaggggtggaggatcaaaagaaatattctttatctgaaggctctttgatcttcagggttgatagaatctgttaaagtgttagataatacagtacctaatgatttctttttaggcttaaatagcctcactgaatgagattatttacttaactgtgattgccctttctgtttcggaattgaccttgctaatttttgaatcaggagcactgaaacagatctctaaattttgaaggtctggctctaggaagcacaagtgtggaagattttaggtcttaggttttaatgttcagagcgtttcttccaattcaaaacgtaatcactggaaaataaacttctaaatgaaaatgtgctttggtcagctgcctctgaattatcattgtgcaacattacttaaataaatttgtgtttgaaaga

SEQ ID NO: 820 - DNA, 392 bp, Homo sapiens
caacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctattt

SEQ ID NO: 821 - DNA, 1387 bp, Homo sapiens
gttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaagccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaaactcagctgctgctgcttccatgtgttctgggttcagaggtcatggctgcaccggtcagaggcctgagtgcctcagggtttggcaatggaatttttaatgtaataaatctttattgagcactaaaaaa

SEQ ID NO: 822 - DNA, 431 bp, Homo sapiens
ttccgcgtgttcgtgcacgtctacatccaccactttgaccccatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccgg

SEQ ID NO: 823 - DNA, 387 bp, Homo sapiens
cctgtccacattgctgtagggaccgtcatatctctgactctgtaccttacaggagttggctagagaaaaggaatagttcttaactctaggtaacatttggactttcaggctcataatttatgtttcaaatagacataataaacatgccatctgttgtggtgaagggtacatgggtgttagagccacacaactctgttaagaatttctgttcccgcccttactttaaggtaaaattacttaacattattgaacctcagtttcttcttctgtgactggggataatatctgtaataacttgctagatcaaatgacaaaacacataaaaacatgtaatgccttgtatttcttttttcttcctattaaatattttgtaaataaattgttttt

SEQ ID NO: 824 - DNA, 629 bp, Homo sapiens
gtgtgaggacagaaagtctacttctggctgtcacttgcaatattattcttcaataaccccgaataacgcgcattgggaaggccacctcgcctcccttccaatcacccccacccccctcgccaacaatcgcgactaatattaacaaaccttaaacttttccccacagcctcgcacccccaacgagggcatctagcgggggacagcgagggtggggggcagggggtcgcgagaaaagccccggaaaggcactaaaatgccacttttgattctgccctcgctgacaacagccgcaaggaccctctccctgcccattgacgcggggctgtgagcgtctggggtcccagcaagtgaggagagaagaggttcggggggagggggaggaggaggaagatcagaaggcacccccagccacctccaccgcctaggcagcgacaaactccccgccccctccccccaaaaagtcgccgagctctcactcgtccagagtccgaggtaaacaacgagcaccacaatggcactaggactttgggggaaaagaaacccagaaaccccgacaaaactgatcaggagtttcccgaatgaaagaggggggcgggcagcgtcctctagagtcgccctggctttcggct

SEQ ID NO: 825 - DNA, 485 bp, Homo sapiens
agagattgcctctttccctctggtctgtggaatctgccagaagccatctgttaatggatcttggaactggctgtagaaggcagagtaggttcctttgagaactgataggtccaaattattctctatccttgggtgccagatacgttgttccaaataagcattagtttgaatttgtaaagaaaacagctttgtacagtagtcattctacaaatagttttaagcagcattttgtatttatataagacaccatcctgctcgaccttcccctgggcacaaagctcacacctggtttacccttttcagagaggaggtgagtcacggaggtagccataataagtgttagaaaagagtgcctcctgcttcagctgaggaagacatttatcatcctccttttgtcctttaattcacgtctttgacatttggaaagtatttggaaagccaaaactacagaccaaaaattgtgcccttaattgagtgtgattgtt

SEQ ID NO: 826 - DNA, 841 bp, Homo sapiens
gtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccg

SEQ ID NO: 827 - DNA, 447 bp, Homo sapiens
gcactcccaccaggagctggaagggacttccttagcctctgcccttcgccccaatcccccgacccccacaggagctcagagtttgattcagagcacaacctaacaagcaatgaagggcacagtctgaaaaacctggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtg

SEQ ID NO: 828 - DNA, 503 bp, Homo sapiens
tctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaag

SEQ ID NO: 829 - DNA, 436 bp, Homo sapiens
tccatcattgctgaatgcatagattaagtatatcctgaaaaatgcataagaagcttcataaaaggaaatccttgtccatgaagcatgaatttgggaatctgttatttgaatccttggcattgagggcataaagatatgaaggtcactcatggttgtccaatagggaagtgatcatttattagtaatgtaatttattattcctcttgtcatctctttctatctctctactaagacagttatcctgaaattctccctggtggtctgagcacatttactgacttgaacaaggaccatcattggtcttttgtccagaatttgcatttgtaatagatagtttttccaactactggtagtcaagtgaaacaaatgttgattttggtttacataagaaatagttttaatctctttaccgcaataaattttgtacttaaatttc

SEQ ID NO: 830 - DNA, 410 bp, Homo sapiens
cacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggt

SEQ ID NO: 831 - DNA, 437 bp, Homo sapiens
gatgcacggctcctttattattgtaaccaggcatgggtggggtctgaaggctgcaatactgatgacacaggggaccctagaagcccaggtgctcctgatggcagagcctccagtaggcgcctccagggagcgtgaactgagaggccccatggcctggtctccctgcggcctgcgcagccctcatcatctcgcccttccctaacccgagcgtgccgcagaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacggga

SEQ ID NO: 832 - DNA, 383 bp, Homo sapiens
caggacgtccagtgaggaggacattgaggcagtagagcagttgattgccgaatgaccacctaccctgacttaaaagatcaacctcagggaggattggagctttctagagtctcttgggacagcagaagcacaggccgggttggactgaatctttaagtggacatgagggacaaagtacctcctgttggtaaacatctcaccaccaacccactgtggtggctaaaatcccacctttagtcccagcaacatatgagcatgtcaccaggaggtcttcacaggcctgtctgccacctgagtgtagacatcttttggccctggagcccagagaggctgaatgtggagagggtggagagaggtctgtagtcctcagagaagacttgcag

SEQ ID NO: 833 - DNA, 453 bp, Homo sapiens
agctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattcttcg

SEQ ID NO: 834 - DNA, 438 bp, Homo sapiens
aattgtgttcataggtactatggtacactgtacactgttttgtaacttgctttttagatggattatatcatatttttctgtatcaataaatatgaattcattacatcagtttaaactgatcaaaaacattttaatcaaagtaatacaattaaattgctaaatatcatagggaatcgaagagtttataatcccaaaccatactctttcttttcctagccagctggggacatttttaattgtttctattttcattctttctgtttcagttcttataaaaatacatatataaaattggctaaatgattaaatgttatagtagttctttaattataaatttgaataatatttgttgacttccaaactgcataccccttgccttgtccaagtaaaactgtaccatcgtttattctctgtgttgtcaataaaacactaagtgat

SEQ ID NO: 835 - DNA, 1123 bp, Homo sapiens
ttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatac

SEQ ID NO: 836 - DNA, 362 bp, Homo sapiens
tgaattgtaagtaataagttgtggaaagtatacttaacttgacagcattaaaaacaaattaattttggtcttatcttaagatttgactgcctatataaggtagtgactgacctatgaaagctcttttatgttgaaagcaagtgaaaaaaaactaaagccttattggtttgaggttagaacggttatttgaaaagtggatttgaaaagaactgaagctgaattattctaaaaacaaaggaatgaagctttatgacagggcacgtgaaatgtttatagtgaaaagagagaaataagtaacaattgaaaaaaacttctagaattccatttagtaacaaagaggtttttgatgaaaattgtttggg

SEQ ID NO: 837 - DNA, 375 bp, Homo sapiens
ctttccctgccgccttgcagaggtctggctgtccttcgagtccccgttgatctctggaattcaggcattagctcccagagccctttaacattcattattctactctatgagctaggcatgatgggggccgtcatgccccttgaacagatgggaaaaccgaggcttggatcacagagctggtgggacacagagccagtgactgacatagaagagcagtggggtagaattacagttccatctggtgccttttctctgagcaaagctgtatccatcaccaccaacagaaagtcccagggaagcgaaaccccagggcagtgtggtgtgattcatgcccacccatctttgtggccttgaaggcaagaaacagaaatcaga

SEQ ID NO: 838 - DNA, 343 bp, Homo sapiens
cttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggcccggataagttccagggccttc

SEQ ID NO: 839 - DNA, 445 bp, Homo sapiens
tcaagggtcaacatgtgctttctttgctaagatttggggatttctgacttcctgccagcttggtacggcaacaaggtgattctggctagagtctcagtagggctgccacctctcagcatggtgccaggagagggagccctggagtcatcagctctggacaggcctggaggtggcctttcaagtcctctgacctgcgcatcctgtgtgttgcaagtgaaggatctgacactagccttcattttcactcagtcatcaagctttctccatctccactgggtatagggtttggacactcagaaaggtacctccacctgggagacagcccaacttttctgtttccaaaaccaacatgaccaacctcccagatttgagacttcatgactcccttctctgtcaaccagcaccacaagggcatggttaacatttattaaatactcactgttct

SEQ ID NO: 840 - DNA, 393 bp, Homo sapiens
ctgcttgtttttgtggagccgtgtgtgttcttctctgagcagctcctccccagaggaccccagcgcagtcccgggagatggcggaaagaaggcaccagggcacagtggacactcatcccgtgacagcgatggtgaccatgactgtgggagaaagaacaggacccgggatggagtggggctgtctgagtttccccagtgaactttgtgctttggcgttccacccctgttgttacttgttactgagtttcctagacctggggtgggtgttcccccaggaggaggggggtcccgacctgtgtcctgtggtggccatttgcagcttctgtgttgtgattcccttctcttcaacggtttcagtacatatctctcttcaataaatttcattcagtgttc

SEQ ID NO: 841 - DNA, 433 bp, Homo sapiens
aactccctggatagtcctttctacaccttaagagaaccccttcccctcttcaaaattggtgttccaaggcaagaagttattttcaccagggaagcctgtgaacagaaagagctcctgagactacacctgcttttaatttggtgtcagtaggaaagatggagatgaaaacctcatcaagaccagcacggatttgggaatcaccaatagagtcaacccctcactctaagatgaggaaactaaggccccctaaggtgaactgtgaactgaattgatgaaagctgggatcaaagcccagatctctgggctccttgtctggtatttatcttccctgctttcttcataattaaattcagtgtaatgacgcagacgtagagcaagatcctggagtgtcttcttaatcatcaaatattgtcctctataaagttataatgtt

SEQ ID NO: 842 - DNA, 571 bp, Homo sapiens
tggtctttttactgtgttttatttcaaaacgttgttttaagtgatagtgtccttaaattttagtgtcatttggtcaacttactggtaacaccagaacaagaaagcaaaaaagtaataaattctgctggcacagaactaacatatcatttggtaactgtaaaacctatttgcagttaaaggttgatttattggataagggactaaaagaagcatatattacctttgcctttatattttttcttcttttaagaaggagcattatggaaaaataaatataaagtcttagtgaatttttgttatggttctcaattcagcaatctactggctgcttgcgaaactgtgaaatcaaattgttcttaacctttattcagtttagtttatagcattactgttttatgaaatgtgacattttaggagccaatataatagagctctaaaaggatagtatatctttaaattctgactggggagtaagaagagaagatattcttaccctactaaataaaccaacttttgagtagtatgcaatattatgaaatgttacaacactatattaaaaataataaaatat

SEQ ID NO: 843 - DNA, 742 bp, Homo sapiens
agcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgat

SEQ ID NO: 844 - DNA, 373 bp, Homo sapiens
gccacacctaccaggccatgctctgggaagggggtgggacctgggcaaaggacacctctctaggactgcacagaagcctttgtgggtgggtgggacattcctgtgatggccttctggctgggcactatgaaatgctctgaagatttttccttgcactgttgcactaaccccagtcctctatcactgccccttcctcctgggcgacttcactgatgttgtggccatgtgaattctctggccaatgaaatgataaagatgatatggcctctgccaagcagacactgtaagtattattgtatgatgcttttgtctctttttttaaagttaaagcagtttattaagaaaataaaggaataaaagaatagcactccat

SEQ ID NO: 845 - DNA, 351 bp, Homo sapiens
ttcatgagctagccataagttttagcaacttgctttgaaccacggtagatttacaattttctgtagtattgagttgtgttcatttagaattttgtaatatttatattgaaaatcaaatttttgtacctacaaaaactacaaaaaatccccctagtttttatagtttctattaaaattatagctggtacatagggatgccagaaggactgtttaagaagctgaaaatagagaaatgaatttatcttctcatagttaggcagggcacagtagaaggatgcttaacattgcaagctgatgggaacagcaggttgatatagcttgtgataacacttctaaagaaaaagcaatgag

SEQ ID NO: 846 - DNA, 676 bp, Homo sapiens
ttatttctgtaaaccaatgagaattcctgacgaacaacttttgtaatcacccgtcttctgattcatccttttttctgtaaaaagttgagcctgtcctttggaatactctccaaggcaacctggaagtgtctcaggctgcagtcttcaaccttggcccaaataagctaccttgacctgctgtttgcctttttaccctaattccccccaggcatccctagatagggaaacaagccacatctctgccctcagcctgggaccctgcttcctgatgatacctgcccatccctgttttttctccataaacttgctgggaaaggtgccctggttctgtttctctagaggctgtggtgccagactggaaactaccagtttcctgggcatgtgccttggtgtcaccgaacagccagatgagacttgtcaccagaaaatgctttcctttgctcctttattaaacacactcatattgccagtactggggatatcccctgagcaaggtgtaggagagcaaaagtagacaaccagataggaagaaaactgaagtggaataaatagatgccaggcacatgaatggtgctttttttcatcaaccttgtgacgttggaattatctcccattactcaagaagctcagagaggacaagtggtcttgacttatcagacatgggccccttttttgt

SEQ ID NO: 847 - DNA, 374 bp, Homo sapiens
taattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgttt

SEQ ID NO: 848 - DNA, 464 bp, Homo sapiens
tttacatccgctccagggagaaatgaagacatggtcctacgttgttctgtaattattttctatgtaaattttgttccttgtcacaattatatatgtcttaggggaaaggaccatttcacatgtgtcacctcacgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacccctgcttagcatttggcacagccagaagcagcaagctagggtcacaacacagagaggggctgtgtaatactggctgcctctgtgctaagaaaaaaaaaaaaatcactgtgtgtttgtttattttggtgcaggcccagtgttcttgcttagacttaatactacccttcatgtt

SEQ ID NO: 849 - DNA, 437 bp, Homo sapiens
caagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 850 - DNA, 496 bp, Homo sapiens
tattttatggccaagtatacttttgtaaggaaatgttgaagtcttgagtatttttattcttttaaaaaactatagttagtgtcaactgtgagcactgataaatattattcatgtgtggttttccttctttttaatccagactttttaagaaactgttttggcatagagctttacttaaaatgctgcttcattttacacattgtgaatactgaagattctaaaaaataaagatgcatttaaaatctctgtgctgttccattgtagaaatggtaatgtgcattgctttgccaaagtggtaattaaatgtttaatggtttagaactcctagttcacaacagggcttctcgtcatcacttgcagcgtgtgagcttccaaataagccgccatttctttggaaaacgcacgcacttaggcatggcgatctcctgttccgttaggaaatacggttatgttgacattatggttactgtgcttgtggttttgcaataaacatgta

SEQ ID NO: 851 - DNA, 421 bp, Homo sapiens
cttggagggagactccgagcctgctgaaaggggcagctgcctgttttgcttctgtgaagggcagtccttaccgcacaccctaaatccaggccctcatctgtaccctcactgggatcaacaaatttgggccatggcccaaaagaactggaccctcatttaacaaaataatatgcaaattcccaccacttacttccatgaagctgtggtacccaattgccgccttgtgtcttgctcgaatctcaggacaattctggtttcaggcgtaaatggatgtgcttgtagttcaggggtttggccaagaatcatcacgaaagggtcggtggtaaccaggttgtggtttaaatggtcttatgtatataggggaaactgggagactttaggatcttaaaaaaccatttaataaaaaaaaatctttgaaggg

SEQ ID NO: 852 - DNA, 462 bp, Homo sapiens
tggggagtttttgttttgttttattttaagctgcattaaactccaatgtatatgaaaggggcatttttataattgtaagttataatgtaaaacttttcctaatgtaaagttagtcaagggtacaatgaggtgttttaaccagaaaatcgtaatcagaatattctagattgccattgtagtcgttcagtgtttcaacatctgaataaattctgtgtcattgtttagctgtcacagtgtgaaaaacgttttgattcacaaagacaagtacttaaaaagaggtaacagtttttgacagcttaccttgcacactctgaataatgttcatttaaattgatacagcctgtagttccagctacctgggaggctgaggcaggagaattgcctgaacccaagaggcagaggttgcggtgacccaagattgagccactgcactccatcctgggcaacagagtgagaccctgt

SEQ ID NO: 853 - DNA, 347 bp, Homo sapiens
aatgagccaaaccccgtcaaaagtcctgtgaggaagtcagggaactctcctctgttagcccaagtggcgccatcaagtaaacccctgccattttgtacaccctgatcagggaggaaacttccataggggctcaggccatgaaaagcattttgccaagcagatcccaggccacactgcctgactgcaggaaatggctcccttattacatcctgccaggcagctagccacactgccccacctcccctgtccagacctataattgccccagtctgtacgcaggacgggggctcagcactcgctggtgttccccttccacaggtttctctgtccaataaacctatgttgct

SEQ ID NO: 854 - DNA, 475 bp, Homo sapiens
taattgttaaaatgaccttctgatgcaggtatttgtagctttgccattccacagatgaagaaacagatgaaaggactgaattgttcaataggaaggagcagaatcaggatatgaacttgggttggcctgattcttggggctgcattctttccataacataattgcttgctgtgatgtcctgggctactctgccaggggtggttagtggagtgaatggagaataatttagacaaggtcagtaactcccatgccatctagaaattaaaagtttaaaaggcagagtctgcaactctccttgatttctacagaaataaagatgatccctcctgtgacagtgctaagtgacaattctgagtgtaaatgcgctttttggcacaaattgtcctgtcctaatagtcttgattataattataaaataatgggtttctgaaaggctgcaagcagttctgggaatggcaataaaggtttagaaatg

SEQ ID NO: 855 - DNA, 443 bp, Homo sapiens
gagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggc

SEQ ID NO: 856 - DNA, 381 bp, Homo sapiens
cctcacccttgtgctcacatgtcccaaccactgccagcggtgccacctctgaatcccagaccccacatgtaaccatcctctacctggaccacaggaggaagctccacgttctttgccagggttcagggtaaggggcatgatctaagttgggcaaaagagagtcatcctgttaccttaaaaaggagtctagggtgagccccagtctgctggtggccatcttcaccacctttggggagagatggcctgagcagacacacaaagcaaagaggtggagagaaactgtgtctttgtgtcattgtttgagtccctggacccagcccagtccccccgactacgctgaacttttcaattgtggaaaacaataaattccatttagttaag

SEQ ID NO: 857 - DNA, 1360 bp, Homo sapiens
tgtaacccctgaggattataacgaccccatgacccccgatgacagccagcagtttggtgactagagttttttgagcctgccattctcagtatcagctttggtctggagatggaacgtggagcagggaatctgacagccacgtttctcgtgatcacgtggactggagttgttttggtatctggggtggaaaattgcaatgatcaagtttcttttttattttttttttacttagaaaagcaaatattgtgtttttgtaataaatcccttgcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggagcggccaggccagttccatcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatctaaa

SEQ ID NO: 858 - DNA, 508 bp, Homo sapiens
tccaagtatcctgcaaaccctggcactttagcatctgaaagacacctgccagactgcctgtggcagtccctcatgcttgacttttggtgcctagggtcctgttctcctggttagagggaacttggtgtgctcacactgagggaaagtgaaggacgcggggcatcttcctgccctggccttcctgccttggtgcctgcgctccccaccatcctgcaaagaggaaccctgggagtgagtggaggtggcaggggtttggttcctgcctgctgccaggcggccttgcccagggggtgggtcccagacctgagagcaaagcgctgttctctgaagtgctttgtagctgactgcatcttgtgccttactcttttggttgattttcaaattttgtaaaagcaaatttgcatctattttctcttttacttggttatagttttaaatgtctctatgaaagggttttgaccttggatgatgtagtatatgcaataagatgctgtgattttatttcagg

SEQ ID NO: 859 - DNA, 422 bp, Homo sapiens
ggaacaccctcatggaacactggcaacatggaatgtagagagctgatgtcttccccctcatagaggccattggcttcctttgtataaggagagggagaagtgattctggaaggagaagttggtatgtctagcttcattgcagcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgag

SEQ ID NO: 860 - DNA, 451 bp, Homo sapiens
taaacgtgagcaggcagcaggatgctacctgataactgagtataacagcatgcaggggaggactgtgtggctggaggcagctgcagtagaagttggcagtgccactgtggacttttaaagggacaactctgggtacaagcctgaagtgtaaggaggacataaaattaaatacaattgagcttgtctccttgaaaactggttctctctttttactacattaaaaagatcaagtggacagttaagtcattaattcaggtaattccaatcacaaaactacttttttcctgaagtgtcctaatcattgatttttaaaaatgatatttctttcatcataaattatcagcataattgctttggttccatatttcatattaagcttgggctgagtgatgtttaaagcctcctgcttaccttccccccttttcttcctattttattttacttaatacct

SEQ ID NO: 861 - DNA, 722 bp, Homo sapiens
aagctggagcgcgccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaa

SEQ ID NO: 862 - DNA, 360 bp, Homo sapiens
cgtggcatataaactcttaattatagggacgtgaagttttcaacatgtgggaccaaaacaaatccttgctttcagtaagaactgcggagagcaatagaaaaagaacttgatttcaaagtccaagtttggtattttgagaaagcaattgcgggaggaaaaagatacttttaagaagtgaaagaatagaattctgatttttgtttatttcctatttcaaaccctgtctttttcctatgtggagattttgtgtgcccaggtcactaactgggtgtgattgactttctcgagggggcggggaaattgactccatacaccgattcaggaccctctcatcagtgctttaaggctctcttctggagc

SEQ ID NO: 863 - DNA, 493 bp, Homo sapiens
ttacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttc

SEQ ID NO: 864 - DNA, 558 bp, Homo sapiens
ctcaccttgccaccacctcttctcatgtttaccagcttgctgactttataatccatcaggtggatgtgtgctgattcacgcagctttccccttccactggacaccagtcctttccagcgtactagttttgctattgtaaatagtgctgttgcaacaatgttgtttatcctgcattttttttttttgtactttttccttaaggataaattcccccaaagagtttactgcttcagagtataaaacccttttacagcattccatgtctagtaccatgctgttttcccaaaagcctgtgccagtttgcacagcagccggcagtgcctcggatggccagctccacccccatgtgccagggccggtgcttgctgcttctctgaccagggcacggtggaataagacccctgctgtttgtgctttgggcggaagtttcccggctcacctttacagcttgctggtactgctgggaattggcacagatcttctgtacttcctgctccctacttgctatctcatctagcaggttctgtaagacagagtttaaaaatcaaaactaaccag

SEQ ID NO: 865 - DNA, 441 bp, Homo sapiens
aggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactttaaggaaagcaaagctgcactaaaatttttaagggaaaaaaaacaagtagccatttatatttgtgaccttgcattaatatttaaatgttgattttaatatggagctagcacacatagatgcgcaggcacgcacacacaaaacaagcaaatgtaactccaggcatttgtaatttaatataataaatacaagcatgttag

SEQ ID NO: 866 - DNA, 497 bp, Homo sapiens
ctgtcatcagcagatgtcctaagagtataattatagttctttacttaatccaaaatttgttctgctctgatatctataaatgatatgattattcaaaataccttgaaatgattccacaattagattaggtctgttgaagataacttattcttaaatatgagtaagattaaataaaagtagtttgagagttgttactccctgcctcaactccatggtattccaaaatgtttttgtgggcactttaatacttgtagtttgattttgtttgttagttttagaaatgaacatttcttagattttcatgggtattttttggctgtatttaaatgtaaatgatataaaagtaagggaaattgtgcaaattatttcttgtgtagtaatcagtggaagtgatcaaacagcttgaagcagtttatgatgagaaaatttaaaattgcaaatgacctgaaaatttagccagtctattcttatttctttaaatttcagaaatacttaag

SEQ ID NO: 867 - DNA, 610 bp, Homo sapiens
atacaggagctctctctgttgttctgacattgtgttatgggttactttgggcatgcctgtgttttaagacttgttcacatgattatagaaggtctaatcataaaccccagaggaaattggcattgtggtcatggttattaacaagtgaggtcaggcttgcctgtgaatttgctgcaccaggcatgtggagctaacatctgcagagtggccaccgcctttttggcatcggttctgctgaaaagtcacaggcctcttggatttgacaatgttatggctctgctcggattgtctgggatagaaacaaatactcatagatcctcctgcttcccacgggacttaacgaaccttcgtttatgggctggtatgctttcccctagacaaatagcacctcattctatttgagtgtaaactagtcggaaaacgtttagggtggagatattgcgtcttttatgggatccacccatgcactgtttgaattccctgattcccaccactcagcgtaaacagctccttttttcatgaactgaggttcaaaaagcagttggcaagtcgtcttttcctatgctgagaaaagggactgttgtgtttaaaaaatagaagtgaacaaagc

SEQ ID NO: 868 - DNA, 435 bp, Homo sapiens
tgtgaaacaggtccaaccatgacactctccagcttagaacctgctggattttcccgcagcccaccgagccctggaggcccagccccacaggaagccaccctctataaacactgccggtttctggaactctgagtctcctgtcatgcactttcctcccccagcccccgcgccctcactgcttctttcttggtcagcctcccggggactcagctcctcttggataggagctctggctgtcggtcaccactgtggccgcagggcctggcgcagacgggataaacgatgaagaatgccacctgcgcgtctggacagcgtagaaccgcaatcagcttgcttcaaaatcagatgctacagcctggctttggggacgccttcctttctaaggcataagtgcgaggttcgctgctgtgcgtggaactgcggccgggagggagt

SEQ ID NO: 869 - DNA, 422 bp, Homo sapiens
agatgaacccatccacaaactcccctgccacatccagatgatgcttagtgaaaagaaacaccttgttccaaaagcagaaaaggaggatgcacggaagaaaaagataccccagaagaaacataaacttaagagacaaacaaattcagccaaaagaaaatgcaaataaaagttcaaaacaaaacaaaacaaaaaaacctctaaaattcataaaacacaaaatgacaaactctattaaatatgcccctatgatatctcttagataaaagttggccgtaatagagaaaatgaagataggtgttggtgactggcagattctgggtctacgatgaatcagagaaggatggttttcactttgttttacatttttttaatgcttgatgttgacttggtagaaagatgataataaagagattcttctgtct

SEQ ID NO: 870 - DNA, 423 bp, Homo sapiens
atgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgattgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctac

SEQ ID NO: 871 - DNA, 524 bp, Homo sapiens
gagtgtgcaggaggctccttgcagtccccagggcccgcctgcacagaggcctgcccttgcacctccatctaagccttctctgaaagactcaggctcaagaaacccctgcccatctgcacccacctgggccaggccaaagccggaggagtgaggagcccccaccgttctcagcaatccctgtcaccatctcatcaccaggagtgactctgcccatactcggacccctgggaccagcccttcagccaccggtctcgacctctcctctcagcccttctgcaccctgggccttcacctgcaagctgaacaatgtccttactgggaataactggttttccttttgaatcttaagaaaatttgtctggctacactctttaagcaccttcctgagccacccgtggccaggctctgctggccgcatctgcctggccccatctaccttccctggaagcacaggactcaccccaggggtctcacaggaacatgcccagtgctttcaaacccagtaaaattttacttagattttg

SEQ ID NO: 872 - DNA, 362 bp, Homo sapiens
ctttttccaaatttttagtttcccctcggccacatggagccattatcccccttggcaaaaaaatttttttttaaaaaaaaaggctagaataacccaagaaaccccctttaggattatgcttccctcaaaggaggcaggcagggaggaccccccaggggctttaaaaccctgggcatgttttctttctccaattgggcaatggggacatggacgttccctgtaacgggctttttctttcgtcttttttttttttttttttttttttgctcctggcaaactgtgcgtgacattctttatggctttttgtatgtcaaaaacttcatactaaactttttaaaaaattaaactttaatgatgggccc

SEQ ID NO: 873 - DNA, 725 bp, Homo sapiens
aagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttgacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggag

SEQ ID NO: 874 - DNA, 668 bp, Homo sapiens
gagctggctcggttatttcggagcgagaccgaggccgggggaagttcctgcggagtgctcaagggcagaagaggtgccgcgtcccgaagaggggaagcggagaagtttgctgctgcccgggtcgcctcgcgacgctgagagaatcgcccagccctccgcagccgcccagcgagaaccggagctgcggccccgcaccggcgtgagtccagctgagctgacacgccgagccggttgtgcctttccgagggaggaatgtgccgtggaatccaaactttggaaaacgtcccacccgaattcccagcgagcagcaaggagaccagagcgtcgatggagccaccgttagttgcgggagggctgtccccaagaggaattcatcactgtcgtccgctgggagggaccaaccttgaaatggggttggtggagagagggatagagaagagccggcgtgcttataaataacaaaacttagctatgaacccttccgattcccaagtggggaagatggggtaaaattctaagtgacttctcgctccgaagagggataccacaaaaagcggagcgcagggtacttggcgtataataagccatcaataatttatgggtgaaattgagagccaaatataagatgataaactgaagaataaaaacagctgacaaatactgtatag

SEQ ID NO: 875 - DNA, 413 bp, Homo sapiens
gttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagaat

SEQ ID NO: 876 - DNA, 382 bp, Homo sapiens
ctccaggctcacagaccacgccggcctggcgggacacaccctaccccaaactcccaacacagatggaggcagcaacaataaagccaaacccttccagcactcagcacggaccaggcaccctttgggggctctgtccacggactcctccccacaaccagtccagctggggaaactgaggctctgggatgctaagtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttc

SEQ ID NO: 877 - DNA, 487 bp, Homo sapiens
ctggaagggccctgggaattcagccagcccaaccccttggtgcacagacaggagacgggcccatgagggtgttggtctcttccaggcctaggagcacctggggcagacccaggctcagaactcagcgcacctgaggcccatggagctccacccagcttccatctcagacagtcataggctaggcctggaagagctaaagaaacctcttggcatagaacccctgtcctactttacagagaggcaattgaggtctgcagcagcaactccgtttacttagtgagaggaaaatgcttctaagaggcctggcctcccagaacaaacccagcaacctggttggtgtccatccctatgccaagggccatgacagccatccacacaagagaggatgggcgccgctcgcctcaccagaaggtctaggcacttctttttttgttttttatttttgtttttttttttctgggcaacaagagcaaaactcctccatctc

SEQ ID NO: 878 - DNA, 457 bp, Homo sapiens
gcgatttatactttttgtcttctaattaattgtcgaccctgaataaggtggtacaactaaggcatattatggaaaactggcattattgcttaatgtaacatgagggattggaatttctttaaagtaattttaagatatgattatttagcagaaatattcactggagcattttacttttagaaattatcgtcacacaaggaagcctttataggaccgactacctaattgcagtcaaagatctcttgaatgaatgaacacacacacacagaagaacacacattttaagaatatagtggtcctatatttttaaaaatttttgccacattttttatatctgaacagaacgtatgtgtctaagcagatgttttaagttatatccttcatgtaggtgagtctgtaaatgtaccatttaacttaaatggctttgtgggaaggtagtttgaggagtttaaaaagg

SEQ ID NO: 879 - DNA, 426 bp, Homo sapiens
atttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagt

SEQ ID NO: 880 - DNA, 500 bp, Homo sapiens
gaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctg

SEQ ID NO: 881 - DNA, 435 bp, Homo sapiens
aaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaag

SEQ ID NO: 882 - DNA, 379 bp, Homo sapiens
agtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccat

SEQ ID NO: 883 - DNA, 381 bp, Homo sapiens
aaggagcctgctaatagcaccctgggtttacatcaagagaagcacctggagagaattaactcgggaggaggtgggggcatgggaaaccttttcatctccaagagcgggcaggaacagcagctggcctgaacttgaaggtacaccaggtagcttgcgtgggccaggagaaggtgattctcttctatgcctctctccaacgccctgcttctgatgctgctcctctacctgtattgaggggaagatacatccctaagaagttccctgaaccccattctttgttgtggctaactggtccccttggaatttttctactaattttcaattccccctctcacctggtgaaatcttgaatcttactgttcaataaaagttcttctaccg

SEQ ID NO: 884 - DNA, 801 bp, Homo sapiens
ctttttgtgtagttatctgaaaataaaaggagagtgctgaagttgaatatagaaatataagtacgcacaggatgccttctggcattgctttaagaaatctgttttcttggtattgagcagtaaaatcaacttttttatggtttatttagaatttaaaataccagtaaactagatctgatatagaagatgtcagtggaaaaaaatgaaaacaaaatcataataaaagtaagaaaaatttaattgatgatggattattaatgctcaaagaaaaataattaaaggaaagatttctacaagaccatctttaagttagttactttctagttattgtcaggtgagacaaactccacgttttattttgtttcgtttacagttagattaacttttgtttggttaactttttattttaagttgacagataaaaattttacataattagagtgtacagtatgatgtgttcatgggtaatgagttttaatgacatgatcatgaaagattgctaaaaattgggacccaatgtttttaattaaaatgagatatcatggtatttgtagaactatctgaatatttccttaaattgaattacttaataaacattatgcatcttttaatatcttttcctattgtggacacagttcagtgttgtactgaagcttcaaaaatggtaaattattaactctaagaataatttatttgattttaaataatattcaactgttttcctttaaagaaaatgatgctattttttgcttattatgaatactgacctcttttctgcccctaaatgctgacacaaggctg

SEQ ID NO: 885 - DNA, 411 bp, Homo sapiens
ttgcttctctgaagttgtcccagcacagctgtggcttccgggagaggaatgtcagggccctgataaggaaatgaagtggagcccgcacctgcccagaatgtgaaatttcttcagcagcctctgaccgggctccagatgggcaagtgcagcccctcccacacctgctgagtttgatctccctcctcctggatgctgtgaggcttggcacctgcccagccaggcactcaggaaacctgctgggggtctctgagcgcccaccagggtaaaccaaggtccctttcttgtgttaaagagaagaactgggatggaagcgtgcccagggctctttggaagcacccaggaggggcaatggaaggcttcctgggaagagggtttctgggttgcattttaaaatacacacaggagttagct

SEQ ID NO: 886 - DNA, 496 bp, Homo sapiens
tgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagtttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactcctt

SEQ ID NO: 887 - DNA, 336 bp, Homo sapiens
tttattccactttattctttagaagctcacgggcggcaggcagaaccttccttttagtgagttgtaaagtcagagagaagctgaaaaattagagtgagaccacttattatttaatgatttttaagagcagggtcacctttaaaccagaattggcttgaaaatggagactgtgatatgcacggctaaaataagggaaatgtccatttgaactgagactagaaagcatgactttgcattgcagctggctgctgttgataaaaatccctcatccctttgaatgttaaattgaaagactaagaaagcatttccaagcgaagtgcttcatgtctgtctctc

SEQ ID NO: 888 - DNA, 441 bp, Homo sapiens
catcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatataataat

SEQ ID NO: 889 - DNA, 390 bp, Homo sapiens
ggtaagatatttaatttagtagaagtaattgtactttttgtgtaacctgtttgttaaagaataactaaaggagaggttaaataatctttatattgagaaggttaaactgaaataaactaaatcattcagccctttgtttttaggtagttggcaaatcacaaattggacatttagtcagtatcacataaatttttttttttgttcaagtcttttgttgaaattacacattgagcttcttaaatctgaagatctgaaatgctccaaaatctaaaactttatgagcagcaacacatgatgctcaaaggaaatgctcatttgagtatttaggtttcagattttcagatttgggaagttcagctggtaagtatgatgcaaatattctaaaatctg

SEQ ID NO: 890 - DNA, 1102 bp, Homo sapiens
gcctgggcctcccgctgctgctgatgcccgaagagggcggctcttggcgatgatcgggccgtgactctggtcagcgccccgcgtccagactctcggcaccacagcctggccctgacatccttcaagcgccacgaagaggagagcttccaggagcagagcgccttgcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtta

SEQ ID NO: 891 - DNA, 440 bp, Homo sapiens
ggaaattccaatacatcagtgcatgtggaggacatgagtatttaaggagaaggttctaggcttccgaagtaaaattggatgtggaggttggggattgattcaaacattaatactttcaagcgtttctatggtatttgtcagctgtggagcaacagcacacatctgtattaatagcctgtgttaagagattactgtgaatcctgaaaaacatcctcattgtagagatgagaaaacacaggcttttgcacatccaatgtctccttaaagcatgtggttcagaattgagaacgtgcagagtgagagtggtatgaattttcctgtaagctacctgaagttctgtttgctgtcatgtggaagaaaagagccttggagaagttttatttttttctgtttggaaagaatacacagagcaagatgatttacaataaaccttttgacct

SEQ ID NO: 892 - DNA, 476 bp, Homo sapiens
atttttaatttgtatcaatctaatgtctgtctttcacatacttccaaacattacataaattattttacctagtgcatacaactttcaaaaactgtatttggcaattaacagacccctgacaattattaacaggggttttacatcccggagtttgagtgtctgcgggagaaccgtccctgcaggaggcactccccctccacctgcgacccgggctgggagaacgcgcggagggctcccttgagcggtctccgccagcgaggctttcctcccggtcggtgttgacagtgtggcatttctgttatctaatttctggttttgactgaaagcgaagtgagttttctcatcagtggagttgtaatatttctgcaaaaaaaaaaagatcacagccctccgatgagccgggcactatgcgaagtctccggctgcctgcgggccgctgtggacgccccggcgggggtcaggaccgacccccatct

SEQ ID NO: 893 - DNA, 417 bp, Homo sapiens
aaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgctt

SEQ ID NO: 894 - DNA, 522 bp, Homo sapiens
caggtcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagc

SEQ ID NO: 895 - DNA, 463 bp, Homo sapiens
gttgttatagagtctttaacttttacagagacatgctaaaatatttatagttgaaatggttaggatttctttcaaagtcatccagtggtggaggaaaagatgaaatgtgtggagatagagataacgataacaacttttgaattgataattgttgaagataatatgagatgggttcatgtggtctgttctactattgtatctatataaaattttccataatttaacaaaaaactcccaatcttacaatatttatcagacctacagtgtattattttctaagttgtttctaaacttgtttccatttctgatgacttaatcaatgtctcaaacatttctaggcattctccatctcatgcattccttctgttcctctgcattagtttctcccttcctgttctactgaattacaaccttgcaagaaattaaaacctacctcccttccaaagaaaaataaatctaaatt

SEQ ID NO: 896 - DNA, 473 bp, Homo sapiens
gcatggatgaactgggatggattgaggcttaaggaagatgtgggaggagggagtggacccacaagcacggtcagttctccggcggctgcagcagggcctgtgtgggaaggcttagagatggtgagtcaggagaggtaaggaggggtggaaactatgaccatatccttaaaaagataaacaacatgcatgtggatggctttgccaccaactagctgtgatcccaacctgttagatgggaaaaggaggtgccttcttggccaagtgaaagaaaggcttgctgtctgctctaagcccagggaaccaatggggaaagaataagctaaatgtgttaacggattccaaattacttaaagcctttatgggaacacggtagattgtaggtaactagatagggttgccagatcagtttgatttgactttcagtataatttttcagtatatgttccaaaaattgcatgggatatgcttatact

SEQ ID NO: 897 - DNA, 1252 bp, Homo sapiens
tggaaaggcttttcttttggaatctctccttaaaaatcatgtagcagcccatggcaaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgtaaataccttgtacctgttcatggattattttattctaaaatattttgtcaaatgtgtatcaaccaaattaaaaagaaaggttttcatgtca

SEQ ID NO: 898 - DNA, 495 bp, Homo sapiens
agctgttacggggcagctggctctggtgcagctgctggtggagaggcacgcggatgttgacaagcaggacagcgtgcatggctggacggccctcatgcaggcaacctaccatgggtcagtgccagccccacgccctcagcgacaaggccagacagatgctctggcctgagatggaggttcccaatgggctcttctggtcctgagatgctgcatacaaaccccaggactatgacgacattgaggcatggaaaaaaaaaaaaaagcggcacaggctcattttagtcccacccttctgtgtccagatttcctgttcccccatcacagaatttcacaatggccctgaaaaaccatgcagcaggagcattttatgcagagagataaggttctctaggttggtttcagttgaacacagtgactgattcattggagttttcacattgagatatagtgacctccttaagtagctcctgtatgaagtaaacattggttattcat

SEQ ID NO: 899 - DNA, 359 bp, Homo sapiens
gccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaa

SEQ ID NO: 900 - DNA, 591 bp, Homo sapiens
aaattgccattcatgacttcgggcctagggttttgagatgaatgtgcagtgtgtgtggccgctctgtgtgtcccgcttccaccagcttggcattaagcacccggagcattcacctgctgggcaggcctggccaggggtgagcccctccattcgggggctcagggtcaaggcagattccttgcttggctttcctgctgatttcctcatgaagatgccaattcgtatttaaacatttgttatcaatggtggtgtttgtgtgctgatttctataggtaaaggctgttgttttaggagccaggtttgctgggccagctcagacctcttacaaagtgaagatactaatgatcgtcttgcaaggtgccatagtgtcgtgagggtgaactgaggcagtggctatgcatggtgtctgcagcagcgtttctgaggctccaagaatatcagttcctttttcagaaatggggccagattcttcggatgtagacagtgttctcttcacggatgctaacaacttatcaaagctataatatattaagtatctctgttataataggatagatgcattcctaaaaaaatgtgttaagcaaaaatcag

SEQ ID NO: 901 - DNA, 481 bp, Homo sapiens
tttgcgtcacacctcaggaccctggaaacaatacacaatttgcccattcattaatttattaattcactcaacaaacttgtacatctgccataagtctgacaccatcctagttatcagggatgtagatagtcaaaagaagatgtaaacctaacctcatgcatctgtgaatctccccatctaaaaagacacagccttgtaaagaagcttgtgtgaaagtgctaacgacagacatgccaagtgttaaggggatgcaggagaggcgtggtaaaatgggttgggaggcagctcagatgtctaaaggggtcaggcagacaatgcagataagtgaaagagggccagttgatgcagagtggggacatctggaaagcacccgccccatctaaaggaggcagcctctgagagtctggggatcagggatagaagggagatgtacttttcactgtacatccttttgtattttttaaattttgttacttaattc

SEQ ID NO: 902 - DNA, 427 bp, Homo sapiens
gttagaactgaaggcaagtaggaattaaaagcagaagacagtcatttggaaacagtcacttttgtgttttgccttggcacatgcacatgggcaattagtcatgagagtaaatattaaagatagttctttaaatgaatgacccaggttgctagtgctgactacgatgcagaactccaacctttctcttccacgtaaggtatctcatgaggggataggagcttctgaactgttaggtcacacagaatgaagattccttgctccaagctaagaagtgaatcccaacagcatcgagtactaaataccttggttctgaaagtcacaaagagagaaacagtggaaacgccattccctctctggtttctgatttttccccatttgagggaaaagggccggttgaagaatagtacaactaagcctatctaggacc

SEQ ID NO: 903 - DNA, 825 bp, Homo sapiens
attttgcactgtggaaatctttgcccaaattactgcaagagtctcgagcatcctgctgtcataagtgcagagtcaaaggaagaaaacgatgattttttaaaccatctttctgctttctagtctcacctgagtgcctcacatttggcagaatcaacctggaatcctgctcataagactatcagggaaatataattcccagacttccatttccagaaaaatgtaataaatacttttaaaggggatggagatggtaccgtgtgctaaccccactctgagacaaacctgggtcacaggaaccatagggaagatgtctgcagtagaaggggacctcgaagtactcaagtacttggctcacaacagcactattcacataaagcctggcctgccccttggtgacctccttcccttacgcctctagactctactaggtgatcagaaatccctgcaagctagttggggagggaagagtgaaagtgaaaaatggagaggaaacactgctacccgcccaatgcctgaagccaaatgcaagcctgggccaggcttgggggaggaatcaagaggaagcttaaacttaaaatgaaatcgaaagtttagactcctacatgggattggacattttaaatgctgaacagagcctatttttatagctagaagttacaggacaaatttttggttaactgagaatgatccaaaaatcatgtgaattttgtgatccagaaagtcacagaacatgccctagattttatcccaggggcagggaggagtgacctgcagagcaagtttgaattggtaaatagaaaacaagaataaaatagtttgctgttt

SEQ ID NO: 904 - DNA, 1175 bp, Homo sapiens
taagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttgtggggagcaagggtagccaatggcagagggggttggggctgggactctggaggctcctccccttctttctcttccttctgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaaa

SEQ ID NO: 905 - DNA, 441 bp, Homo sapiens
atcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtac

SEQ ID NO: 906 - DNA, 840 bp, Homo sapiens
aacaatcaaggttgatttcttcctcatatcttatgtcctttgcgagttggcaagagctactcattgtggttatttgtgggcctgagctgatgcagctgcccccatcttgtgctaatcatagtgccagaagcaaaaaaaaaaaaattgcacattgataaattaagcagtgatggctaaaagcctcctacccaaagcaacacattctgtttctgctcatgtttcatgagttaaagcctgtaacttcaaaggggtagggaagtgtaatcctaccaggtgtctaggagaagaacctgaactgtttgatgaactgaatacttctaccactgtgttggttttcaaggaaggggtgggaaagtctttgaaaactctcctgtgacccataaagttatatcctagaagccaatcctttctgtgttcataaaatcactggccttttcctgtggccgccaaggttgcagagagcagagctgtttgggaactcacttcaagaagtggtcagagcttgaggagggagggtcaggacaggagcagaggcagatggcatggcactgggccaggttccatatgacctgggtgccagcaaagctggccttggttttgcttatgcttgtatttgttaccaacctatatagcaagtatcacagtagaaaaacttacagaatggcctgactacacagagctcactgttgaaaaacgctgggttgtaactctaagatagcatctgctacattgctaaagaatgttttataacagggcttagatctgttaggaatcttagctgctactgttgcaacaccaatttatggaaagctgtgttatttattttgaaatataaacatg

SEQ ID NO: 907 - DNA, 385 bp, Homo sapiens
ttaattagcagttgatactagaatggactttcatggcgttcacagcctgggatggcccacgtcatctttaaccttgaactcactgatgtttgaattattcagtagctggcttagccatattgaatttcaaataagtgttcaatggtgttagttacttatttctaaatggtacacaacattttaaatgttttgctattgatttatagtgactagtttcctgtctgatttgagaggttctgacaaattttttaagaaacggatgtaaccatgaaatcctaagtagaggacccagctaacctgtacccacaatcctgatacacttgagactgtgagataaatttgtgttgttttattctgtatgataataaaacttacaaataaaatg

SEQ ID NO: 908 - DNA, 412 bp, Homo sapiens
cctttatcggctgaatattctcgatgtcaacagtatgagcaacagaaaataaaaacttggaattcagtgacagctttttatgtaactgcctcagttttcttagggtaatcaagccaaagagaaaatcagagatgccaaggatagagtggttgagagaggcccatattgaaataggcacacgattgtcaccatttctcactttacaagctgtataatcagtaagctgattctttttatacttcaaattatatgaacttgacctcatatttggctgcaaataccctgatgattctcaaatctaatgctacatcttagcttattccctcgagctccagacaatgtgtctaaccaaatgtttgcatttgaatgtcccacaggcatttaaatttagcttgtttaaaatctttttctg

SEQ ID NO: 909 - DNA, 486 bp, Homo sapiens
ccattatagagtcctcttattggaatggattagaggggaaggaagaaacttaagtcattataccaggaaaatcattccctcactattgcaagagttaggtttcataatctgcctttcaaagagcaattacaaaagcaataagtaattttgttgtaaggattacaaatacacctacatgataaattgggggccggggaggatggtcctaatgtggtaacttgggtcaaacttgccagtgagtcagacatgtatttgagaagtgctgcatctcagacagcttagatgcaagtgaaggagatacactttgagaaatggactgtagataccatgaagacgttgatgtccaagatgcatgtagagagtgaataaaattgttacttgaaatgtgagaatgggaaaaaagcaatattttgtattaatgtattatatatataatgttattttaaatatgcatgtgtaactaaagtaataaattagatattataa

SEQ ID NO: 910 - DNA, 409 bp, Homo sapiens
caccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaaaattatatg

SEQ ID NO: 911 - DNA, 368 bp, Homo sapiens
ttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctggaagcctatgggaactagtac

SEQ ID NO: 912 - DNA, 871 bp, Homo sapiens
caaagccacgaagaagccaggcctttccgagactgtaaccgctgtgcagatagcgccgatccctgggtggccgctctctcgttctgcgcgtgcgtcgttctgggctgggagcggatgggtgctgaggcgtgtgacgtctctagtagtgtcgtaactgggtgtgctgccttttccaggtgtactgaggtcttcgtgagattcagggctaggactcgtgtggctgtgtcatgttccgaatgaagcttaaaaggtgatctttgagaactgaagacttgagacccctccatgggcccaggggctgccaacactaataatttcagagacttagaatctgaggagaatctccaatctaaggggaaacggaagaaggtcaggaaagagaaggggcaagcttaagtgactcagaatccaagaagcaagtctcataggagagctgcgatcgaggttaccatacagtatccaatcgtctcaaccttcccatccatacttccatgctgtctttcctctgaatgcaaggaaaaccggttacacaaacgctgacaaaagaatgtcagacttgaatggaaattcggagcagtacccatctggtccatacagcgaactcccagtgagcaccacggcaatgtaactaattcatgtttccctcttggcagtgcgggaaaggcagcaaagagccaagttttgtatcttaacagttctttagttaagaggcacacgctattttgcattcttccctacttttgataatttttggctgcactagtaatgcatgagtatctgctcatttaaaaaactcaaactttttcagtgaaaagtatgcccttttcttcagaaagtcttaattaaaaaaaaaaaaaaaatcattgcccag

SEQ ID NO: 913 - DNA, 679 bp, Homo sapiens
ggccaaggccacgctcctccgggtcagcggcagcgacgccgccggctacttcagggtctggaaggttcccaagcccaggagaaagccgggacgcgcgaggcaagaggagggcacgcgcgctccctggaggaccccagccgcgccccggagctcccggaggcgccgccagccccttcgcaaggcggccaggaaggccagagaagtgtggagacggaacgcgagggcgaaagccaaggccaatgccagggcgaggaggaccaggagggcaaggccgagagccaaggagccgccgtgtgccagagccaaggaggaagcgggagcgacagcggcagacgaggggcgaggacaggccgtgaaggaagacaccacgccgaggtcagggaaggacaagaggcgaagctccaagcccagggaagagaagcaggagcccaagaagcccgcacagcggaccatccagtagccaacgcgggctaaaaccgaccggacatctagcgggcaggggaagactccactaaagacttccacaaagacctcccctaaatctgaaggtcttcctgatccagttgggaatgcatcttgtgggagcagcttcactcccaccacggaccaatgcctttcccccataggccccaagaagagcggctgtcacactcattgaaatgaaatggacctctagacc

SEQ ID NO: 914 - DNA, 438 bp, Homo sapiens
ttgcaacccacatgtttgtaggtgtatggtcgatggaagtttctggcatccatgttggtaataaagagataaaactgaaaaggtttttattgtggattacacaggtggaggaaataacatgtaaaccaaaacactcacatgtctctgattttagttctctataaaacactgtcatttttgaaagaaccatgaagttggagattattttaagatgtaatcaaagcaggatttttgtggacacagacactcttttcttgcccaggtatgttttccacataatatcagttctttcatgaaatagaggagaccgcaggtgcctttttcattctactaatcttaaagtgttgaatttgaataaggaagttaatggtagccatccgtaagaaatgttaaagaggagacgacttttctaaaataaaaaattggaaagtaacctgt

SEQ ID NO: 915 - DNA, 379 bp, Homo sapiens
tattttagcttattttttaattttattagaattctggcacaatatagcccttgtttgcttttaaaaagatgggctgttagattgcctggattttcccctttatccactacctatgagcaaattacttccctcagctttagtttcattttgtagaaaatgggattatttttgtacctcatacgtataatagtagcaacaaaaactttgcctagttagtacttaatacttttttcttgccgagattaaataagctgatgtagcttccatgcttaacactatgcccttcattggctttggcttcacatacgctttggttctgatcctagttctactgtgagtttacaggttaatttctctgagccttctttacttaatcagc

SEQ ID NO: 916 - DNA, 470 bp, Homo sapiens
agtgggacctagaatactttgtaactctttaataactgaggtcaggaccgctcttctgccttccccttcccttaacgtgctttttcccatttccatgatttaaggcaatggtttttccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtc

SEQ ID NO: 917 - DNA, 348 bp, Homo sapiens
aagtttgagaccagccagcgcaacatagtgagacctgtctctaccaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatatt

SEQ ID NO: 918 - DNA, 403 bp, Homo sapiens
ccgctgggaccgaagccgtaaccgaagccaggcccgcagccgctactcactcggaagctccagctaactgtaggatcttccacaccctaaggcttcagcttgagaagcacttcgaagccagagcagaaccaaaactcacttccatggggtcaccgggggtgcctgggcggcctttcgtgggcatgcacgcaaggaattggggtggcacacgggacacccgagagctccaggagccccgtgaacccagaccacccagtgccatggccacttagggctgggaacccgaacctggtgactttgaaaggatagagcttcattccataccaaagacttatcacaccatgtgcctatacacccagcagcccaaggtggagggtgcgtggaaatgagaaagctttttacc

SEQ ID NO: 919 - DNA, 434 bp, Homo sapiens
ctaagcattttctgagttagtgccagttgaataatatgacaataagctataggagttcagaggagagtgagttctgtggactgaaatagtcaaagtggattttcagagcagatgagacgcgatgaaggctggggctactttggtgttttaagaacattaattaggcagcaggaaaatctgaggacagggagactagtaaggaaggctggaaagagccctgggtttggagttcagagatctgtgttcagagtcctttgcttcttagtgactatgtgaccttgagaagataacttgagctccctttttcctcttctgtgaggtagaggtaagattgatgtgcatattgatattgtacttaaacgtgtttgtaaaatgctaagtaaaacctaatgctatgctttgaatgtagtgggttccaaatatttgtttaatga

SEQ ID NO: 920 - DNA, 475 bp, Homo sapiens
gaatcccggaatttggaaaccccagatacggagggcggacggtacaaccggagctgtcaggtggatttccaaggctttgcattggctgtacctgaaacttatggtggcctagactccccagtatccactcttccttatcttggtaaacaagcccagttctgagtcacatccctgctctgcctacttacaggggcatgtggtcccaatctaagcaacgtagcataattccaacctaaatcagcagaatcccattccctgccacagttattggctggcaatgagcgtaacatatttgggccaatgagaggagcaatttcctggtctttgttgggaaaagtttttctttcattttctgagagcgcttcagaggtaacccattctttctgcatgtcctcaaaaaaacgggtcccctggatggtgggtagccatcttccaaatacaagtctagccgggttaaaataaagaagacatcaag

SEQ ID NO: 921 - DNA, 425 bp, Homo sapiens
gagaaaacaaatatacctgtccaaaccatatacttttaaaagagcatttttttttccatacaagctgttgttaatttgggggtaaagtgctgatttgcaaacttcatcaaattgttcccaagtggattctccttgtttgtctccccctaccaaccccaaagttaccatatttgatgtaagaatcaggcatgttagaatgttgtgtcacactaactgattctgctctttttgtcttgtcattcaagttccgttagcttctgtacgcggtgccctttgcagtctggtgtctcttccagaggcgagggggctgaggatggggtgctgcatctcactagctatactggcatcatcttggtaaactgaaaaccaaatgtggacatttgtaaaatcagtgcactgtttctagagagagattaaattcattt

SEQ ID NO: 922 - DNA, 474 bp, Homo sapiens
caagcagcaaaatgagaactttatttggtgcagtcagggctccatttagttccctcactctgcttctaatcaccccttctcccagccctcttctatttgatagaggtctgtccctcagatcagcaatgtcttagcccctctcctctcttccattccttcctgttggtactcatttcttctaacttttaataaacatttaggtataatacattacagtaagtgctatttagatacaaacttaaaacatactatatattttaaggatctaagaatcctttagagaaggcacatgactgaagtacctcagctgcgcagcctgtagccagtttttttaatgtaaaagtaagaatgccagccttaacctagccctgcagataaaagctaacttttattaataccagccctgaataatggcactaatccacactcttccttagagtgatgctggaaaaataaaatcaggggcttcagatt

SEQ ID NO: 923 - DNA, 734 bp, Homo sapiens
gttttctccagcatttgaataaattattgtttctttggttgaaccatgatgagataattggcttaaaccaggagtcatgcatggtatctggaaacttcctcacttgaatcaccagcatcatactcagcatgcataatcctctcatcatgagaggcacaggggaaatgagccagcctgtctggaaaggaagcaaatgcatgctttccatctcccactcagtactggacatgaggctatgtcatcaccacttaatgccagcaccacttaaatgatgtttctctctctctgccctgtacttgctggaggcacatgcccatatcacgtagggtgtcagggcagagagctcttaggaagagctgagctgtggggacttcctcccacgcagaagagggaggcctccgcagaattctctgccatgtgcttctaggcttcctcaactcagaaattttattatagagttttagaatgtgaagagctcttggaaatcatgaaagatgaagaatcaagatggaagtttgatggcttgtcccaggccccagagtggaccctttgctttttggaatccaacagcaaggactcatgggaatatcgtgggatttgacttggagagacagggctcaaacctcatctttgtcacttagtgattgtgtaattctctaaaagtctatttgtagaaaagggataagggagctttctttcctggattgcaagatgattaaaagagatgtatgtat

SEQ ID NO: 924 - DNA, 684 bp, Homo sapiens
gttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaa

SEQ ID NO: 925 - DNA, 514 bp, Homo sapiens
ggtctcactcctagtcaggctctggagatcatcaggggttgtcaaggcctgaacgtgatgggctgtgatcttgtcgaagtttcaccaccgtatgatctttctgggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttctaaggaacttggattaattgggggaaaaaaaaaggagtacttgtactgctttgattttttttcctttgatgaaagatggaggataaaggggaagtgaggagaatttctttcaagattatctaaacattagaaacatgacatttaaaaaaactatgaaat

SEQ ID NO: 926 - DNA, 421 bp, Homo sapiens
ttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactgg

SEQ ID NO: 927 - DNA, 448 bp, Homo sapiens
gagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacatcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcctacc

SEQ ID NO: 928 - DNA, 465 bp, Homo sapiens
caccagttctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacat

SEQ ID NO: 929 - DNA, 473 bp, Homo sapiens
tttcagcaggtcactataaacgctttctactctgaagcacacaggggctggggctggccttcggagttacgaggaaacgaggaccaggaccagggattctgcatcagcacagccgccaggagccggccggggccccatccctgacactgctgtcgcccggctgtacctgggtgctgtgtccgcggggcgtctggagacgtcgatgtggtcatagcagggcctggaacggggaggtctggcctgaactagagaaatgaggggcgtatccgcttctccaccctggcctcagatgaagaggctctgggggcaggagggagtcagacacgtgcagggcaggcggcctgtgcagggcccaaccctccggcaccagaacctgacctcctcagaggcccccaccatggagggatgtctgggggatgctgtgcgctgccgctacgatgtttggttagagattaaagccatttcagaagtgg

SEQ ID NO: 930 - DNA, 675 bp, Homo sapiens
gagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgc

SEQ ID NO: 931 - DNA, 464 bp, Homo sapiens
gagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggtt

SEQ ID NO: 932 - DNA, 389 bp, Homo sapiens
atgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactag

SEQ ID NO: 933 - DNA, 406 bp, Homo sapiens
tcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatga

SEQ ID NO: 934 - DNA, 569 bp, Homo sapiens
tgcctatttttaactgatcatagtgtgatgtccacagaggcacaatgtatattagtactttcttccatatttggtacataatgaatgcctttggtactcattttctgaatggtttgctctagtaggaaagaaaaaaaaaaaagcaagaggcagctttgcctgcactactgaggctgtaccaccagaaagcttcattcccatggttcctctgtatggcatccaagaagttgcagagtcccttgtgtagttcagagagcaggggtgtttctcaggatttcagagtcatcagctgctttgaaggtgtgcttccttcacctgtgttttaacgccctgccccaggggtggtccctgtctcccttgggtacagtgccctgtgcgaccttgggtgctctagttccaggtttgcctcgcttcccctctgagggtgttctggagaagcagtgctttttaaattgacgggtcccatcctctgccagttctagactttatttcaagaatcaccagtgcaactatatatacatcttcaggttgctgtttttatttttaataattattaaatacattttctc

SEQ ID NO: 935 - DNA, 438 bp, Homo sapiens
gcagggtgtgtgggcttttttctcgctgccccgaacttgatacaggcataggcattgatgacattttggtctaacttccttaactttcaaagagctttattcttattcattggccaactgaacaattacttacaaaagtcagtactataactttttcctggtagaaaactttgtttctagttgtgcaactttggagggagcactatggatgcagatgattttatctatctttaaagttatcttttttttttttgctgataaataccacagattattcagtaaatggctaaaagttctacttacagtttcttacaaatgttgccagcatagttggaattgctttccttagtattttttgaggaataatgtttacaaagatacttctcagtgtataggaataaaaatgttcttctgcttcttgcattttccagaaatgta

SEQ ID NO: 936 - DNA, 433 bp, Homo sapiens
tttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatggtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggt

SEQ ID NO: 937 - DNA, 660 bp, Homo sapiens
cttgaagtgggctggtggaatgtcgccctgcctcggctcctttcccgtcaacaggaccctctcccttctcccgggtgccggcataggggtcaaaagccccccaggattctgaatcacagctgcacactctgggggcactgccatgtggctttctaggaagaaaaagcacctgcctgattcccaagtccctcagccccaagggaccacagcttcggaaagggatgtggggtgggcacagggcgggcaggggtccacaagagagctgcagggggttccgggacagcactgggctgggaagttgggggacttgaggctaagctgctgtgtgaccctggggttgtcaactcccttctctgggcctcagtttccccccctctctaaagtggaaggagacattgcccgatgtctaatgctaaatctgcaggtgacttgactcccagcttgggaagggaccctctccctgccctagaggggcttcagtccctctctactccagctttcttgacccccacacctgtttctagccccagaccccccagaccccacaccctctcttggcttccttcctccccccgccagccccccggccctgcacaccccagcagagtccctgggcagcacagtaaagacgactggtttcggtatcagtttgtaaacttt

SEQ ID NO: 938 - DNA, 396 bp, Homo sapiens
gccatctatgaggaatttctgcggatgacccggaatggtacccagctgcagaacttcaccctggacaggagcagtgtccttgtggatgggtattctcccaacagaaatgagcccttaactgggaattctgaccttcccttttgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcgg

SEQ ID NO: 939 - DNA, 615 bp, Homo sapiens
tcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggctaa

SEQ ID NO: 940 - DNA, 523 bp, Homo sapiens
ttttaaagaaacaaatttaattgatttccaaggcttgagtgtgattaaaaaaaaaaaaattaaaaggtaaacttcactgtgcaggaagaagcataggaaaagagagagagaaaagaacaaagaaaaaaaagaatagcaagtctctccaagtactatggaaacaaacagaaagtggaattaggaaaaaagagaggaagaaggtctgagtagtccaagggacacgggaggccagttgggaagaccgcccgggcgagaccaggaagatcaaggccacagtgaatcacgatcccatccctctgctcaacctgaattgtactgctgctggcgagagagatctggtcgaccttagacatggcaaggcgagaggtgaggtccatcaggtcgaccttagtccaacgctcacagccgacatctctctcaaaataaataaacaaatccaacagtaaatatttaacaatgacaaaaaaattaaagaacaatacataaacaggttgcagttaacaaaagtaaaaagtaattaata

SEQ ID NO: 941 - DNA, 491 bp, Homo sapiens
actagataaagccatgagcttgagatggtgtacttgaaaggaccgtttcaagatcaggttttataacacactcattatttatttcttctgtggagaggagaaaccaaattggattcaagtatttttctgatagtaatctatgtttcttagaataaagcaagttcatatctgagccagagggcataattatgtcagaataaaatataattatgtcggaataaaatgccctgtactaaagaggtcaactaacaggctgggaaatcttaagttttgtttttaagacaaatccttgaactctctgtgcctcgtttctcatccctaaatctgtgcaactcacctcacagggagttgtggagggtaatatactgctaatttgttcagtgtttcacaacaataaattatgcctaagatctgataaaacatagcaaacctcatttatgtaagtagagacaagcatggataagacttacagataataaagaaaattcatt

SEQ ID NO: 942 - DNA, 469 bp, Homo sapiens
acattaaataccatctttttagccatcagtaccactgggcatgtgtcataaaagagaaatgggggcagatatagctccctttcatatgctataccagaacaaaaatttgtaaaatgcataagtgcattaactgaatatgtttgaatttaaattctgggtttttaccttcaaagcacaggcagctgtagatacaaaaagtcctctaatggagtactggaatgtttcattgtcttcacaacttggagtgtcagagttttctctgccttctatattgtaaaactgagtgactattcttggtcgtttttattagatttattgatgtccaagcaatacaagaattaactgttcatatactgtatgtttccttaacatgcttatttggtttctttgatggagattgtcaaggccaaagaaactttttcatttgtcatccaaccaataaatggacagaagctgttagaagctcttt

SEQ ID NO: 943 - DNA, 539 bp, Homo sapiens
atcgctttcctcacttttctcctctaacagaaaagcacttagatgaggctacagggagccagagttcttttgacttggtgggtaccggaggattggaagaatctagattgagtattccttggcctttggggagcttgctctatgcaaagtcacccaggaaatgatactccccccactgtgaaacactagctagagatgatagacaaaaagcacatttgttgtaatctccctttgacgggattcaggttgggatagatgtcgaagcagctgcttctaggtagtcaacgaagatgtcaactagtaaatgacaacagacaaggatgagcacagcagagctgtaagattctagatatcaaaaagagcaagcagtctgttgtactcaccatcgcatcctcagcagctgcccagtgcccggttttaacttagtgctcagtgtatgtgtcaggtttgaatcccaattctgatactacctgtgctactctcttcacctctctgagtctgtaaaggattatttaagaattaaatgaaacaacatacag

SEQ ID NO: 944 - DNA, 443 bp, Homo sapiens
tgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacaa

SEQ ID NO: 945 - DNA, 687 bp, Homo sapiens
cttggattacaggcatgagccaccatgcccggccaaatgacatacttattttagaagcagtgtgtatagattacttatttagaaaactaatagtaaaaggagagaaaaataggacagttgttaaaggggataccagaacatttgaatttttccccacatgaaagagaaactgcctattgtgtaagggggcactaggcttaagatcttatgggtaaattagtaacggaaagaaaagattctgagtaccagtgaccatggaggtaggtggctgctgacatggacagatagaaatacaataaaatatatatctaatgaaatgacacatgctgtttcatcacctgcttttttgacttcacactgattgtttttctatgtgtttgttccacatgtttacttgctaactgctaactgtagtattctgtgtaccatagctatgtaatcagtattttcagtttttcctcttttttttgctggtatcgatgcttgtagtgaatacttatatagatgtgttacatgtctttttacacaacacttggtttcctagaagtgcaacttaggttaaagattatgaactctaggctttttgcttgttccctccaccaccataacctcactagaggctattagagggttcatttccttgtccccttaccagtttcactatgcatgaaagaatctgtcaattta

SEQ ID NO: 946 - DNA, 726 bp, Homo sapiens
catctcctgcccctcttttcatccactgcatttcagccacactggtctttgccaacttaaaaacacaaagttcattccccacttaagacttgcaacagctcctccctctgcctgacatgatcaacccgagcttcccacacttgccattcagatctgagcttaaatgacacctacctgaagaggccttcctactctcccactcttccactctccattctaaggtcgcatcctcaccccacctaccaccagcacctccaccctgcttatattctcccaaagtacatcgcactacttaatattttttggcccaattattttttgtctcttctactagaatgttagaattacaagaaagagatcctgtctgttttattcactattgtatcttcagtactggaacagtacgtggcacttagatattcaattattttttactgaatgtttacaccactcctgagaagaataagcgtaagcgaaagaaggtgaagctggctgtcctgaaatactgtaaggtggatgagaatggcaaaataagtcgccttcatctagagtgctcttcagatgaatgtggtactggagcgtttatggccagccactttgacagacattattgtgacaaatgtctcattgcttcagcaaaccagaagacaattaattgtgtatgagttaataaaagacatgaactaacaaaacacatttactgaatgaataaatgtattaataatt

SEQ ID NO: 947 - DNA, 482 bp, Homo sapiens
acccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactggttctatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtctaaaaatgatcattcaagaagagcgaaacagcaaggtgatttgtgaaagagatttattagaaaatgaaacacatttatacctctgttcaataaaaatctgcttttcgtc

SEQ ID NO: 948 - DNA, 351 bp, Homo sapiens
aatagagacacctctaattaattaaagcggatgccctccccactcctcccaggatttgactcggagcacaaactcttcacaaaccaaaatgtcaggacaccatcgccagtgtccactggccactgctgttggtgtgaggcagccaggagcccctcagaactagtaagtctgagaagaggctgcacggggcctaggagagggagaaatgagcccgtccaaggtgaattccttgattctccattgtgagtgcaccaagaacaagcactccctccgactgactctcgcctaccaggatctggaacaccttccattaatttattcgttcattcaataaatatttattgactgact

SEQ ID NO: 949 - DNA, 749 bp, Homo sapiens
ctttgtacagataaaggttatagatttcttgtgttgaatattaaaaaatcaaggatgtctaaccattaagattatccactgtgcctggccccaagttttgcatcttttaatgccctctgaacaaatacatagagaaaactctcagaacaattaaaacctgcagagcaacagtgtcctccatgtcttaggtttcaagtttgcctctaaaattctaatccatatttttctacttctcagataatttatgtgtgtgtactcttcctagacgtacaagagactttttaatgctaaatatttgtcagtgcttaacaaaaactcaatttcacattactcatattgtttttgttttaattgaatgtgaattaaatttttattagttatttgatttggaatgttatgtatgccattaacactttaggggaatctctagcatttctgtatttttaaagaatttgaatcttttgtagaatctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaacttta

SEQ ID NO: 950 - DNA, 401 bp, Homo sapiens
tagttaaaaatgtgaacttattattaacctcaattttttagaggcctccaatctttttaaaatataaatatttttgattgacaaatcataattatacacttatgggggtataaacctcaatttttgtaaccctattttggcattttcctgtccttacatctcagcttaaatgctccctcttttgggaggcctttttctgccttcaacatagtagagccttttcccccacccctctgtaacataatgccctgttttatttttactgcttttattttcatgctttgtgggtgtccccactggagtgtaagccctatgggagcaagggctgacctgtgactgttttatctccagggccaacagcagtgttactgtatagtatgtactcaataaatatttgttgg

SEQ ID NO: 951 - DNA, 456 bp, Homo sapiens
gttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaatg

SEQ ID NO: 952 - DNA, 732 bp, Homo sapiens
aatgccacagtcctcacctcaataaatgagaggacattgtggcagccaaagccacaacttggaagatggggctgcacctgccaacgaagacgggaaatgacccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacatttatctctgcactcacattttgtgacttatgaagataaataaagtcaaggg

SEQ ID NO: 953 - DNA, 367 bp, Homo sapiens
gtgaggaagctgaggtggagccccagtctctgcaagggagtgtagcatgttgaaggagggcacatccagtcctcctactgtaaacagctgtgaataaggtgtcaccctgaggcagacggatggctcagctccttaccacatggatggctccttccttccttcttcagggtgcgctggctctccctggaagtttctctgtggaaacaaaaagggccctggcctggctcaggcttcatcaccattgctccagcctcctccctgcctccagtaggtccctcacatggttccagagggatctttttaagcccggagctgaccccacccttcttgtggctttatgaagaaaagtacaatctgttagcttgtc

SEQ ID NO: 954 - DNA, 691 bp, Homo sapiens
catatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtatttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatcctttt

SEQ ID NO: 955 - DNA, 428 bp, Homo sapiens
tgcccaccagcttaaccacagcacacactgcaactcattcatacgagaaacacatgaaatgtaggctgtgttgagaaataaatagcagaattgtaattaggggccagaggaaaagggtgtgaagaccatgtcaagatttatgcctgtgagatgggttgcagaattgacctgagcagaccaggcttccgagggtcaaaaaagcgtctgaaggagagacactgagtgcattctgggttcacattcccctcctctactgcattcctgaattttctgcctcacagcggcatctgaagcagtggctgtatgtgtccttaaccacccttcaagtccacaacatgtcatattacctcattttggctccctgggactattttggaggacctgaattagtcatgtggggtacttgattaaaaatcacttgaacagcc

SEQ ID NO: 956 - DNA, 443 bp, Homo sapiens
ctgtggctttgtaccttccattccgtaatgtgctttcatttattcggcatatttattaggtattgactgtgtgcctagtactgtgctaggtgctagaaatactaagatgagtaagacatgtttcttgtccacggggattttatgtttcagtatgggagacaatacaggcaaatatacaactgacaagtagcccaagtcagtacagataaaagtgcaatgggacaccagaggagaggcttttagagaagatttcatagctggatggatagaatggctctacaaaaaagagaaaagaattttcagggcagagagaacaagggacacaaaggggaaaaagcaagtggcatgtttgtacagtagcaaattttctttggctggaggatattaaaggggaacaagcaggtatgaggctggaaaaatatgttaaagcaagaccctgtctc

SEQ ID NO: 957 - DNA, 529 bp, Homo sapiens
agactggattgtttcctggtagcaatgccactttcaggatactagaggttggttgtggagctggaaatagtgtgtttccaattttgaacactttggagggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaacc

SEQ ID NO: 958 - DNA, 829 bp, Homo sapiens
tcacaaagaagaaacaaattgatcaggttgccagttaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagc

SEQ ID NO: 959 - DNA, 434 bp, Homo sapiens
atattcagaaaggcacatcgtggtagtttaagtgtacaaggccttagggcagtatctagcccagtattattccagattctcctgagctctatataaagggcattttggaggaactcttctgggcaatatctttcccaatctcatctaaattctgggaaatattttccatagcagacaacccagctctgaaactaagcacctggtgatctttagtttgagatgtctatatggtacttttgagttatatcaattaagatacaagctatagacatgataaaaatatgaaatcaagatatagctcagtgggattggattaagacataataatagttctaagaattcacttttgattgtatgttttaccaattcaataattccactaatcaagtattcacattttgacttttgattaaataaaaatttgaattaaaatt

SEQ ID NO: 960 - DNA, 418 bp, Homo sapiens
gacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagctttggtcatgatgtcttttaccatttgataattttaaacattgtttttaaacccaaaacatttagtggtccgttgcctctgaagatgtaaacaaacaaatacactatttctgggaacatt

SEQ ID NO: 961 - DNA, 584 bp, Homo sapiens
tgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagacccct

SEQ ID NO: 962 - DNA, 339 bp, Homo sapiens
tattttttattgttacatttaaaatagattttgctggtagtgaaatatgaatgataaaatcatctcctcagctgttttccttgcataagtaccttaaaataatgtatttgcaatttccttctgaatccttgaataaaagacaccagataatcagaagatgttactgacattagtaggcatttgaagttcactctgatgggatcagtctatttacaacaaattgctatagagagtaaaaagcgccaacattttcctgtagtttttgaatgacagcatctttgttcatgcagttggctttgctgcatttccacttcatcaattttttggctctgtctttgc

SEQ ID NO: 963 - DNA, 451 bp, Homo sapiens
accttctaataaattggatcagctgagtttagacttgtaatttattttttaaaacaaagagggcatattaaatgagtaatttggaaatacttcagatgaataaataacatctctgcaacttcctttttctcctgatcagtcctgtgagtgacccttgataacttttcttaaaagcaatatgagtcaaccaaagaataagattaatttttgaggatttgtgataaccagaagaaagcactgtaggctgtgacaacctgtgagggccgagagaaatacaggggagccaactggtgatccatattggctttcatagagtggtagtatttttgtgtcagcttgttacatgcctgaacctctggattgcagcagtgttgtcattgtaccagcagttgctcagactctaatcagagtctgatttaccctcaataaagttctgtacgcatcagattgg

SEQ ID NO: 964 - DNA, 986 bp, Homo sapiens
ctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagctttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaactatagacattgacatggaaaagagatttaatgttttgaaaaaaaactttatattaactgagtaacatcctcctgatgagaagtactatattaaatataaacccattatgttataa

SEQ ID NO: 965 - DNA, 434 bp, Homo sapiens
tgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaatgttgtgtagtcagtactaattactgacattataagcattctcaaatgcaataaaaatgctggttgttcacgctggtagt

SEQ ID NO: 966 - DNA, 388 bp, Homo sapiens
caaagagccatggataatgctgcaacatgagtggcacagaggggagtacacagagagagcaattaatttggtgtggggaaggtggtgatctgaatacagcagcagtttgaaagtgttccgtttttaaataaacagtatgcttattttgatttgtgactaggtgtagaaaaaagcctgcatagtgttacatatttatagtagttctttgtaaaaatgttaagtggatgagctattatgaaagtaaaagtttcattttttctcattaaaattagtactaaattactatggatcagatgataatattaaatagtactctgtagaaaaaaggtttcaagttgaattaatttatgtactgattattaatacagaataaatgttatattgactc

SEQ ID NO: 967 - DNA, 402 bp, Homo sapiens
ctttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcgcttcttcctggatgtgaagcagaggcacgatggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttcctgaataaagaatgactggagagac

SEQ ID NO: 968 - DNA, 339 bp, Homo sapiens
tgttagcattaaggttatacagctctcacttcaccttatatgtaatttttttttcaaagtaaataatgcagattgttgacatcctagaaatggtttctgggtggtattatatggggcctaggactctgaactgggactagttgtttattttctgggaagtctgtattcttattctcaactgaacccctgactcttttgttgtattttttatgattccgaaatgctttgagggaaagatattttaatgtgtacaatttgttttattttcatactgatctctatttttgtttaaaaccatgttgcatcatgaaatcacttaatccaaaataaatcttcttt

SEQ ID NO: 969 - DNA, 375 bp, Homo sapiens
aatctactcacaccctcctcgaggtattaaataaatatttcagaatccacaatgcagccaatctcatcaataactttactgaatcctgtagcccagcactcaggggttctctaaaaccctgccccgccttcccctccaattgcggtgcccactgtctcttttaaatagactctgtcctcatcaagcctgttctctgtcccccaaatatgccgtatcattccttaatgcatgcattttttccccagttccctacaatcttataattagtggttacgctaatctatatgtgtgtttaaactcatagaattgtatacaaaaaagtcaactgtactgtgtacacacatttaaaagataaaatgtgttcttttaacgctt

SEQ ID NO: 970 - DNA, 355 bp, Homo sapiens
tttactgataatacttaatccatgtttagatttcataaaatctaaatttgcaaagtaaatttacatacccatgttggtctaaatgtgcttaaaagttttccaataactgaaatgagtatcagttttaaatttaaaaatttgttacttggttactccatatttcaggtattagtggctaccatattggtcagagcagattcataggatgatttcccaggtttgaagtgtgtgtatatttctggtattataagatgtcagactggtttttggagaaatatgttgtcttaatttttacctgctttgatatgacctttctgtgtgtacgtgtgacatttctttataaatgcaacatgtt

SEQ ID NO: 971 - DNA, 463 bp, Homo sapiens
atctctataatctgtgtttcatttcacaagggctagatatagggaaatcggtgaaagactagactaaaaataacatgtaattcagtaatatctagttttgcagttacttttaaatgcatttaaaagattcctcatgtagagtgatatcctaatatccttgcattgttttctgagatgccggtttttagtatttcttatttttggtgttatgttttgctgtattccagcagagctcttagagactgggggtgggggtgggtgtcataaatcttattttgtccaaagcttactgttttagctattcatgttaaattaagaaaaggcttagtgggttaaaattcacctggttttactgttaaactgattttgactttaagagaagccaaggttatggctgtggtttagtttgctagtaaatatcaagtggaaaataaagatactttaataaaaactgtatttcctc

SEQ ID NO: 972 - DNA, 356 bp, Homo sapiens
gccatggttcaaaagcagcctaccacttggggtcgccctggcgtgcaccccattaaggtccctacttcaaggagcagattcttcaggctttccatcttggggtctcctagtctatcagcagtggaggaaacctctacagatgctgcactgtgtggtatggaaggcactggccacgcgtgactactgagtatgtgaaatgcatctggtccacactgagaagtgttccaagtacaaaacacacatcagattttaaagacgtagtgaaaaagaatgtaaaagatctcaatcactatcagaattgctcattgaaatgataccattcaattggatgaagtaaaatctgttattaaaattcg

SEQ ID NO: 973 - DNA, 409 bp, Homo sapiens
agggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcatt

SEQ ID NO: 974 - DNA, 549 bp, Homo sapiens
atctccagaactgtgaggagtaagtgttgtttaagccacctagtctgtggtatttttgttataatagcccaaatggactaagaaatgaagagaaattaagatggggagggctattttcataataaggagcagaaaactaggaagagtagatatatttagaagggttaagaggagaggggagaatgtatatgtttggatagggagggacaagatgcccaactcatcttaaaagtgctgttgattcctgtgaaatttgtaacactcatttacattatttaaaaataaactaaattcgaacttgtcttggaggcatgaaagaaaaaaaaagacatgtttttagttattgtatgttactctgagctacacattatttaacatctctgaaactggaatatattttacaattgatagactcattttaattagcaggttattgttttcttagcagtacataagaaatggtgaatcttattgattcagtggcatttagattctattaaatataatttttaactgaagttgtacatagttaaataaaagtttactatg

SEQ ID NO: 975 - DNA, 441 bp, Homo sapiens
gtaatttgtcttttggttttgtgtaagcattttgctcttaacttggatgtagctgtgggggattctctgttaaaaaagtgagattgttcgatggagactaggaagagaaagtgtactccctatctgaagtcactcatctgtttcttcccattccttcttggcgaatgttaagaactgaacatttggcgtggacactagctacatagtagattaattatagagagttgttggacatggaaaatttggtgttttggtcctttgtggacatttactttgtattattgtcctcttaacaccaaattgaagtataatcaaactgctatatgaagaagggcctagaaaatgtggaggttttacactacttgccctgctttctatatctagtttaagctgttaggactcaatggctctgattttgaccataataaaagcattttgatt

SEQ ID NO: 976 - DNA, 473 bp, Homo sapiens
gcttccaccccctggcccattcccctgcaggctggaagatctttctcctgtctggcttctcttcttttcaattcgctgcaccaagtgcttccagtggcccaaaaatgctttttgaagtgtgttttgaaacagcccccaccaacatacaccccaccaggagtactgatcctgcctcccttcatgtctaggggaagcattcgcctttgagcacttgtttgcaaatctggggagtttgagacctcctagcatctcttcccttctttccctgcagtctattcactcccgcagccaaaaaatctctggcgttcaggttagcagtttctgggttggtttgtgtgggtttttgttgttgtttggggcttatttttttcaaaaagtgataaagacgggtgggttggagggaggggactgatgggctggtgggctttttagttttcctttgagaaaaagactggtttatttaaaacttgtcc

SEQ ID NO: 977 - DNA, 501 bp, Homo sapiens
gcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctggtgagccaggcacccgcaggccccccgtgggacattacagaggcctgagaactcagcaccagggctcggtgtgtgtggtgttggagtgtgtgctatggaaccgcagaatcgatttcagaaagataatagagtccatattatatagggtgtccacataattgttgtacaaaccagagctttttaaagtgaaaagcagtgctaaaataattattgcaaaacaactggcttaaactggagctgtcccagcgaatcaggacgctcagtcactctg

SEQ ID NO: 978 - DNA, 528 bp, Homo sapiens
attctatctctctggccttctgaaccctcttcccactgctcttcagacaaggcaggcagagccttgtccaagcccgccgcacggcccagccagaatgggcaagagcttggcctggggctggtggaggcacatggccttttctctagttctttctatgtctgatgtaccaggtgacagcctcctgcccagataataagtgaagtgggaggaagtcagtggatgggggtggaaagcacctggttttcaggagacagcttgccagggaaggccacacccaccccagggcgtccttggcttcaggaagtcctcaacatcagctgctgcttgtcctccatcacttccgtcctagtcacagtccctgctgagggcagtggggtgcttccatcatggagcactttgtcccattttcagtcagattatctcagatgtggctcttcccagctgtccacccagatccaggaggttgaaatagaaagtgcctgagcgccactgcactctagcctgggcgacagagcgagactccgtctc

SEQ ID NO: 979 - DNA, 817 bp, Homo sapiens
tgaattgtaaatagaatagaaattataaatgaacttttcaatagtaattattttttaatacgggtacttaaaattgtgtcaacttcttaacaaaagaaatggaggcaaaattagtataaacagtttatttgggccaaatttgagaactgcaatgtgggagacacgtcttcaagttgctatgaatataaactccaattagcagcagttacaagcggttttttttttttaaagaaggggcagttctttagttgcatataaactattgattggctatacatttttttttaaccataaattccaggagcatgaacataatgggtgagggtcacatcccctgggcatggatttggggcaggatgtgacaaaaatctcatactcatgtctctctgggcctgataaattttgcatactttatatagttcagactcttctgagctacgtttctttctcttccttttggttgagttttttttttcttctgaaagtattgatgatcaacattttagatgtaagtttgtcccatgtcactggaagacttagttttagttagtctcatcccacattggaggaagagaggagagataaaatggcttaagaatgcagtgaagtctcaaggccaagttgattggcaacacaaagggacagggcaatggtatttcaggtcatctgcttacaaaggagctatggcatgttggatcatttctaagcatctagctatcattattttagtgtttttgttgattttggacatctagaagtgcaaagtataatcaatttgagaataaaagacatgatgcaaataaagacaattactaac

SEQ ID NO: 980 - DNA, 436 bp, Homo sapiens
gaggatgcagtgttcatgaaagcaaacactgggccctcaccaggcaacaaacctgctggtgccttcatcttggacttcccagccttcggaactatggagcccgcactctccagttcatcaccaccccagcatccctactcttgcatctaacagtttccgctattttgcaccacctgcctggcccttatgggcaactcaaggaagaaaggaaagaagagatagaggaaaaatggattcaacaaatgaaagtgttctttctgactactgctgtgtttacaaacattttaatcatcaaaacatgctttatttgatagaaagatcaaatctgcctttgtaaaacaagagactattttaatcattaagacaacacatatgtttgatttggaggcgtgttctcattcaaaaccttgcaaaatataattttttcttgtctggg

SEQ ID NO: 981 - DNA, 435 bp, Homo sapiens
attgtccataatggtttctttctgaggttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaac

SEQ ID NO: 982 - DNA, 464 bp, Homo sapiens
catgagaccattatgagcaggacacgacattgtttcacaccttgggctgtgactatttacttctcggtacagattactctggttaaatcactcagtaaagaaatcttttcatgctcacaatctgaacctgaaggctattactgaagagaattgcatctgacaacaaaatttaatttacttccagagaaaggaccagaagaaagtaaattttcatttatgtttttaagtctattgtcttaaaaagattcttttcccttaaaaaataaaaaaacctgatgtgatgggttccttcagtcaacaaatacttattgagcagttattgtgtgccagatactgttcttggtgtgaggatatggcactgaacaaaacaatgtacctactttcgtcaagcttacattctagtgaggaagataaccaaaacaagtgactgaatataatttcaaatgtcaataaatgctgtgaag

SEQ ID NO: 983 - DNA, 479 bp, Homo sapiens
ttggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatat

SEQ ID NO: 984 - DNA, 697 bp, Homo sapiens
ggcggaccacctgttgggactgcgagattctcaaggggaaggactgggtctcatttctcccatctcagcgcttagcaggatgacctggtatagagcagggaactgggaaatgtgggtcaggggatcagacactccagttgggtcttttatataaattaaatggcaaaaggctccatacccttctccttctttcctaccctccactttatctgcaaaatgggaatgatgataacacccacttcatagaatggtcatgaagatcaaatgagagaataaaagtcaagcacttagcctctggtgcacaataagtattaaataagtatacctattcctccttttccttttttaaaaataatattaccaaatgtccagcttatacacatttacaagacttagctagtgggctatgttagagctactaaaagatctttgacaagctaaaactaagatgcaatgaatgaggtgtaacgaacaagagagttttaagttcagaaatggttacagaagtataagacagctgtgtgggtgttttttggtttttggtttctggtttacaatctcgtcattcaacaaagatgggagttttatagaactaaaagcaccatgtaagctactaaaaacaacaacaaaaaaggctcatcatttctcagtctgaattgacaaaaatgccaatgcaaataaaaatgattacttttta

SEQ ID NO: 985 - DNA, 1341 bp, Homo sapiens
gggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttggccttttgtacaaagattagtttcaatgtagtctgtagcctcctttgtaaaccaattaaaaagttttttaataaa

SEQ ID NO: 986 - DNA, 783 bp, Homo sapiens
tgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgacaaaggaatgtaggactttgcagccctctttgccggagaaaggggttgaactggaccctcatgtcagggactggtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcagggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacgt

SEQ ID NO: 987 - DNA, 628 bp, Homo sapiens
cggcacgaggggaggagtgacttcaccaacatcactcataggtgcttgtgtccgtggtgagaagggtgatggagagaagtggctgcagttcccacccatggagaggtcactggtgaatcccagctaaagaggaaggacaggcccggcctgagtcccacaggcttaccatctgagtccttctgattgggattgggtaccaggcggcagttatcgggaccaggaggcacataatctgggatgccatcattgtcatcatccccatcacactcatctccaagtccatcgttatcagagtccagctgggagctatttggcagctgtgggcagttgtccttggtgtcctgatgcccatccccatcgctaatcagaagaacaggttggtgaaagtcccgaactttgtctccccacccagaggacaactggccaggaaatctgcctgtttcttgtctcaccctctagtccacactctgcctaacactacgccctacctcacattcctagcttccctgcttcatccccacctgatccaaattctcacaggtcccccagccaccccttcagccccaggcctgcaccatccccatccacgtcgttgtcacaggcatcaccaaatgaatctgtatctgag

SEQ ID NO: 988 - DNA, 402 bp, Homo sapiens
cccctgtggggctgacctaccttcctagccgtcttcccagaacgtaatgtgtcttaaatccgtcatgctgacctggggccctgggtgcccttgggcaggagctgatggcactagtaccttgataaagttcttactggcaccagaagagaataaagtaactctccttccccttctctgacttatggccaggtgcccattcccactggcttgccgctccccagctccctgcgctttatattgttgaggcctcctctctcagctaagaaacaggaagtacacagatgtgtattcttaaagacagcattagccacggggcccccaccctcaaagggtgggagcgataactgctgctggttgaaactgacagttactactgataataaagttaattgttacccagtc

SEQ ID NO: 989 - DNA, 479 bp, Homo sapiens
tggggggagtggggaagagggagtggaaggacagtggctgaggggcttcctgttgcagccttcagctggactcagggttggggtcactggaggaggaggtggcttcctgccccattgttctggactgcagtgtttcttgggaatacttactgtatgtggattttcagtaaccaacttggaaagctgtatttgttcccatgattcagcaaacaatgagtacctactgtgtgtagaagcagcaggacagcctgtcatcactgggaaagaggccagaagagccgtttggccagggtctccaatttaggctttcaacattatctctaaagaaggttatacattatgtcggctccactggctgatgggatcaaagaccctccttgtatatccttaaacctgtactctattaccaggccactgtgcctgtggagcactgtaagttcctaccttttaataaattttataattatcttgtgagcagc

SEQ ID NO: 990 - DNA, 487 bp, Homo sapiens
gaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcatt

SEQ ID NO: 991 - DNA, 454 bp, Homo sapiens
atttaattcctacgtacatgcgcccacatctcgtcagctggtgcctcagagaaatgcgctgacaaatcttaaaggtggggcttcatgacaaaagtccgcccgttattgctgctcaacagacccatcaagtcacgctgttggacaggcctcgtggcgcaacggtagcgcgtctgactccagatcagaaggttgcgtgttcaaatcacgtcggggtcaaacaaaacattgttttccctaatcaaatagacctacggtgacatttttcaggataggaaaaaaaaaaagcctcctcagtagaaggataggaggggaatgagacaaatatgaacgttattcagaagttgggtgcagactttcaacattatgtgatatatccctgtggcaaaactgcgcatgtatccctaaggtctataaaagtaaaaataaatttaaaaataaaaaaattccctgttgt

SEQ ID NO: 992 - DNA, 942 bp, Homo sapiens
gtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccagggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 993 - DNA, 646 bp, Homo sapiens
aggacagacggacgcagacggcccgacgacctgggcgttcggcggaggggcgctggggcctgactcgcggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggttttaagaaagactggcatcagctgtttctcaatgcatcagtcacttgttcgcagatcaaacagaagacatgtgattgcatgaatcggcaggatttacttcctgttacagagtgagatcctttctgtaatctcctaacactgcatctggtccatactactttaaccttttaataagacccctcttatcctggaagtggcttcttaaaacagtcttgtttgttcatcagggacccacggacaatgtcagtgtgttcttcctccctgttttgccgttttcctggaaggccagatcccatgatagagataactaaaatgactttttctggatctttttccgtttcccaaaaatctgtggtcctgctgcatccattttactattttctcatcaattctgcgtttttcttctaggaaccttactttcctaaggtgtgaaatc

SEQ ID NO: 994 - DNA, 429 bp, Homo sapiens
gggggacagcaacccaggaaggcctcggagcagggtccggaagtcccatgtgtcccctcgtccaggattcagactcttactgtaggagagaccaagccgtggggcagccaccatcactttgcccttgcctgggctccagatgagtagaacgtgggccacgccaggccaggtggtggcagtgggcaccaggaagagttgtctgcaggaggccagcagcccgaaggcagggcagtggtgcagcaggacgtgtgtgcggcccaggctggtgctagcttccccgctgggctccagagtccggacgcacacacagtggctgaaagcggctgctggcgaccctgacgggccctcggcccgggcctgccgctcctcgcaccacaccaggcggcctcggagcgccgccactgccacaacgcgggctcccccgcccgg

SEQ ID NO: 995 - DNA, 382 bp, Homo sapiens
gctccgagggggatgccaaatcctgggcgcctttgaatctgttctgtgatcacgctgaaaagatgggaaccctgtgaacaggggacaccatcctgcttatttgggtcttacactcttgtccaaagaggcactgtatatgtctgtttttccactaccgtatcattgctgttcacatgtaatgtgttgtttgttcacaacaagcgcctggttacacattacactgacgaatgtgctgatgctccagccatggctttgatgcttctgtcatttttaacctcttctattaatatttactgcctgtgccattcttttccttgttggccattcacaaggcttggataatcgtgtgacattttgagagccatcagatgttacgtttctc

SEQ ID NO: 996 - DNA, 474 bp, Homo sapiens
acttggccagctcctaggcctcctgtaggtctcagcccaaatgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgcggaaactattttttttgaatgggcttctcaagttctaatactgggaaattcctgctgcttgcaaacactctggaaccaacctacctgggtttcagcccagtgcagctgggcgactctaggcaagtcactcgaacctctgtgtctcaattaacttatctgtaaaaatggggggaagaccacctacctaatgcagttgttatgaagattaaatgagttaataacatgtaagtactt

SEQ ID NO: 997 - DNA, 437 bp, Homo sapiens
cccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttg

SEQ ID NO: 998 - DNA, 430 bp, Homo sapiens
ctccaacatcccagagaagatcatccaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccacagac

SEQ ID NO: 999 - DNA, 442 bp, Homo sapiens
caatgatagtctttatctcattgaacactcactgcaatttcgatggtctcattcgttcattgagcatatttattaggtgtgtcttccaagggtcatcccattcgggacttaatacagctggaaacagtggtggcccgcccccaccccagtggagctcaccttccagtaggtctaaactggtttgattgagttccatggaaaacaacaaagtggggtaaggggaaaagtagtggggagctgagggggtcagcatgacatggaagcagaaatcaagagacaaggctttgtggggtgtgggtgtgggtccaagtgccaagggccagggagctttgtagagtgtgtggttatgtttctcagtgtttcctcatagttggttaactaatacatttgttcatgcaattaagccatcttttcattttctaacatttttaaaaatacatat

SEQ ID NO: 1000 - DNA, 543 bp, Homo sapiens
cttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctg

SEQ ID NO: 1001 - DNA, 458 bp, Homo sapiens
ggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttg

SEQ ID NO: 1002 - DNA, 433 bp, Homo sapiens
agttaacttgaattgaatagacttgaattgagccaaaatggctctgggaaacacagggcagtaaattctcacagcaacaatgttaagcattacctcaacttcctcattaggggtctccccagagacccaccacctccagagtctctccctagctccccagccacatcgcccctcctccactgggcagtcctcattgcttcttgtggaacagagctggggatggctcattgctgggctcggccatgacctgcatgggctggttgttcagggcagcctcgcgcatcttgtagtacatgaattcgttctggcggaacatgcgtagctccatctccgtctgcacccgcatggcctctaagtccttagtgatggggtgggagggtccgtgtgtcaccaggagaatggcataggctttgtcattgttatctgcaaagcc

SEQ ID NO: 1003 - DNA, 432 bp, Homo sapiens
atcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaagg

SEQ ID NO: 1004 - DNA, 460 bp, Homo sapiens
ctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatatttt

SEQ ID NO: 1005 - DNA, 434 bp, Homo sapiens
tcctgaatctcaaagttaaagagaaaaatatataagattccagacagaaagaagttatttgcaatgggaaaagaattggactggtatcagacagtggaatcatatctatacctgttaagagaaaaggaaagtaaccaagaagtctctttccagccaagcatcattcacctgccagagtgaaagggatgcagaaaggattccaagaatctatcatctgcatatccccatctgaagaaactgaaaagaggactgtaactaaataacaaattaatgagaatagagacttcaagaaatgagaaggtaaagtagaaagggaagatgatgagtgaacaataagccttgtaatatacatgggtatgtatcttaatgtacttggatgatgatgaaatgactgaaaatgtgtactatatgtgttaaataaagactcttaagat

SEQ ID NO: 1006 - DNA, 397 bp, Homo sapiens
aatcttatgttatagcttactcttaagaagaatatgtgaagccaggaacatggttaaaggtacagaccagaaaatttctgacatgtgataaatatttcagtgacttttcagatttatttcttgttagccgctgtgtctatttggtgctacaaaaactgaaagaaacaaaatccctgatgtaagggcttataataaatacacagtttggagatgaactaaggatattttacatttacgggaaaggattggacaatagtatcattttctcaccatttgcatgtacatcatgtctttccaattgttttcattatttttctgaaagagctgcaaaattgtgcagtggttcaacctgaccaaagtggtattatgctgctgggaagtaaaagtattagacacc

SEQ ID NO: 1007 - DNA, 765 bp, Homo sapiens
ggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagag

SEQ ID NO: 1008 - DNA, 404 bp, Homo sapiens
tgcacttggttgcaaagaatagagatggactctgccaacataggcacggaaggtttacggggtggatggcatggctcacagatgtgatgagaaagccccggaagaagtgttggcacagccttaggcacaacctttcctgggctcttcccatcactgaatgatccatgtatctccgggactctccttctagatccaaagtttagggcggcggaatcggactgctctggcctttgacacgtgcctgtgctttgcctgtcaacgctatggggagagagatgtcagcttacagaaaattgaggttctgtgattcagtttccctctgctctcttagaataaaagtgcttactcattgtttaaagcattctccaaattagtctgcaaattctttgatagtatacatcctt

SEQ ID NO: 1009 - DNA, 424 bp, Homo sapiens
aatgtccatgaagtcctggattttatctaaaaagcccaggcaggggtggggcgggggcggcggggctacagttccacgctgagctgcctcctggccgctcgtccccgccgcagtgcctggcggcccgggcgcccgaccttggccgtggacaccttcgcggtgcgtgctgctcctccccatctgccactggaagatgctggggcgacccggctccaggtttagcaggacactgagaaaagggaatggctgcctttcggaggctgggtgagcccttctctgtgcctcacctgcccgccccacagcggccctgcacctcgtcccacggggcccattgccccggtaggatgcgcgcttttgttttgagggtcaggcatcttccctgccgtcgtttctgggaggttgaaaaattgatccagaaagacct

SEQ ID NO: 1010 - DNA, 459 bp, Homo sapiens
gtgcagattcaggaggagcctaaagcggtagcaacaatgagttagactcaaacccgtctcctgactcccagtctaaggctttacagagactctcttcctgacccaagcatggcttccttgggtactgggcaaagtcctaagtgtcctgcaaccaagtaaagaacaaagaactaatcatgactgccccctctccccccagcagcttaacattgaactgtcttccaaggcaaaggtgaggcaggaggcagcccagtgtagtgaggtggtgtgtgtaaagtctccaaatgtacctggctacatagtgcttgctggaagctaggtactctgcacatgccctacatgggttgttttacttaatgcttgtaacagcctcgaagcgtagattatccccagtttacaatgaagagtgcgaagtgtcttgtcgaaattcaaagagaataaactactgacatagatttg

SEQ ID NO: 1011 - DNA, 505 bp, Homo sapiens
caaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgc

SEQ ID NO: 1012 - DNA, 516 bp, Homo sapiens
cagatttggggcaaatatgtcaaagtcaaacttacgcacatcactactgagaagacaaagatgaatgtgtgacagtttcctgcccccaagaatctttaagcattgtgaaggaagattaatatagccaaataactagagtgatcagttctaccagagaggaccagttttggaagccagaggaaaaaaaaaaaaaaacagaaacaaaatgatgtttgaattaaatctttaaaagtttctcttataaatttaccaagccacatattgggaatggtaccccaggcagaaggagtagagtaagcaagccagaaaggaaatactatggtgcttttgagtaactgcagtgtggctgaagaatgtggaaaatgatgaggataaagaggtggacagggaactaggtaagggagggcttccttttaaataattagaccttgtcctgtgtacatttaatgggattttaatcaggccataatgccaaatttctttacttcggaaggatctttatggtgatggtttcag

SEQ ID NO: 1013 - DNA, 514 bp, Homo sapiens
agccacagaatgtgatataaagatcacccctgcttactccagaatgaacagcctgagacacatatcccttcagtagttggtcttgtgaatgcagtgtcctagtgcaaatgcccatcatctgttgaccccatccttgcccctgcctgccccatgctgtggatatctgggccccctcatcacccatcctggccccctgaccagtgaggatgccccctcccatctagggtactctgcgtctaaggatgaattccagtgtaattttctctcttctgtaggtttatttatggaagattggacctgttcatacatctgtggggcagccctccatctcccagctatataaagtctctaaccacagtgttgcattgtggggttaccatgtggtctgacacttccttgcatgaactaccctcactccagccctggacagtccagggcctagcaggcagtgtatggggcctaccaggtcctggcatccaagctgtgtccaataaagttcttaagatgtgactgg

SEQ ID NO: 1014 - DNA, 656 bp, Homo sapiens
cagactcctctagtacttggagatcttggacgtacacctaatcccatggggcctcggcttccttaactgcaagtgagaagaggaggtctacccaggagcctcgggtctgatcaagggagaggccaggcgcacgtcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttgccaccatacagtggcctcaaagcaaccatggcctacttaaaaaccaaaccaaaaataaagagtttagttgagg

SEQ ID NO: 1015 - DNA, 338 bp, Homo sapiens
cctcccactctctcctcagcaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 1016 - DNA, 381 bp, Homo sapiens
ggcacggggcacggggggcagctggggtcgtcgttaagggtcacgcatctgtacagttgaatttcctttctcttatcatgttttacccaccttgtcccttttttccccaattgtgcttttgcatttttttccttggcaaatgtaaactcagcctttcattcatgacgtgtgaaatttcagtttctctggagtttgtcagacggcgtgggaaccacgcctgaaactcaggtaataggaggaaaaaaaaaaaaacttaaaaaaatttttaaaaaacataaaactactctctacctctggctgggcccagcctgtctcgccctggccgcggcagggtggcctgtaacaatttcagttttcgcagaacattcaggtattaaaagg

SEQ ID NO: 1017 - DNA, 380 bp, Homo sapiens
ttacggaaggaattattgggaattgaaaaggtggcattagtctgggatgataaggagttttaaccatttgagtccatggtatgggaaaaattgccgacgggaacatattttgtatggttttgcttatttagtaaatgtttgtaaaagcctatatctgtgcttttaatgggtttgggtattttagggtgtggaatagatttccaggacttccctgatttataccatcatgctgtggaaaagaaggtttgacctcctccattgttcaggaccaactgggaagggacttggggatgcctttgtttaaacactccctctcacttttcccatttgaattctgttacactggggttccaaaaaaaattattaaacgttttgctttg

SEQ ID NO: 1018 - DNA, 496 bp, Homo sapiens
gttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacgaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgt

SEQ ID NO: 1019 - DNA, 485 bp, Homo sapiens
acttgaagtagattgtctgaataggcatcctcatctatatttacccaaaacctcgcttactgtcatgtgcactacaaattgcaatttggaaacctactgtattgaaattctgtcagtttatggttcttgaagactgatgtcctttcccaaacactggttactgcagcagcatttttaatgtgtaagtgaagaaaaaaggccactaaggccaaagattttttaagaatcattgtacaaatcattatgttaaactatctaagctttgctgtaatactgttttctcttcaatatgtgatggtacaggaaggatgttaaatgaaggggtggtattgcaggagagcattttaaatggcagaagtaaaaagttataatatttataattttgatgggtttaagtttatttttgtagggaagatttttctcccctaaaatagtttctagaatggcaaaattgtttccattattaaaaattgaagttattagtt

SEQ ID NO: 1020 - DNA, 392 bp, Homo sapiens
agacacgtgtgactgtagtcggaccaccaatggcaaagcagtggctgctgctcatgttccattgcgtggggagccaggactccaagtgtcacgctcgaggtctgaagatgctagagcgtgtccgaagccagcccctgaccaatgatgacctggtcacctccgttagcctgccaccgtacaccggagactgatctcccctgggaagaggggatgagaggagaagtcttggcttcgcttttggtgagaaagacatgaaaaacactgaagaaagtttgaatttgtggccagacctgcccctctcaggccttctaggcatgtgtctgagggaagtctcctgagtgttagaagtgttattggcaaagcaatccaataaaataagctacctatgatgc

SEQ ID NO: 1021 - DNA, 783 bp, Homo sapiens
ctgacccaccttgaatgaagcctcctccaacaagtctggaatccatccgaatttaaattaacaggcgctcctatgaattccatcagagaacacacagtagatgctttagcaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggcttggggaagcagcaccccacagctttggcacagctgcagtgacctccttgcctcaggatggagtcaaacctggaccccctgccattctcatctgcaggaaacactggcctccttcatcctcaggctgtgttgctggaagtcacccatctccgaggccccttgggatcgactgagtgaccagcagtgaagttcatccaccttctgaatggatgccatcatctgaagtgatggagctcagtgggatgttgttgcggtcttccctcccttagccaggatgtccctgataaaggatgacacccaagcctcagcacaactggccaaacttgaggtggtcatctcagcactgatgctgggccaacaattagccccatttgtacatttttacaaatttttggcaattgccaagaattatccaccttccctccccattgaattaaagaaacttcttgcctcatggatactcag

SEQ ID NO: 1022 - DNA, 468 bp, Homo sapiens
gtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagagggacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagattaatgataacgtaaaagtatattgattaaaattccccttacaaagt

SEQ ID NO: 1023 - DNA, 391 bp, Homo sapiens
caccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgagcttcctgtttgacaatgtttgctgttgattttttgttcaataaagaatttggtaaaa

SEQ ID NO: 1024 - DNA, 627 bp, Homo sapiens
gaagtgcaattccatgttaaacatgagtcaaatttagctgaaggagcaagtttggacaagatgcctaaagcacagcagtttttcacaatgttagaattgataagtgctgtaatgtatctgaaaatataagtaataagtaggtttgcagtggtgtgctaaagccagcttatagacatgcaggaaccaattgttagttgacgtgttgatggcttcaaaccagtcagtgaaagtatttacattatggaaatcaggaacttttttcctcacaaagaaagattgttgttaaaaatttacctgctcaccactggatttgggacgtctgagggtatgaggcatttggttggcggaatcatgctactacatccttttgcactcttggcttgggtgtgtgtcttttcatttcatcagctgtcctaaattctggaagaaacctgtcagggtaaagtgtgtattctgtctttggctcaaaaaattataggaatgctgaccccagttacacatgattctctatcagcctaatacctaaacaggaaatgctttaaagtatcctaagttccagctcaaccttctttttagctatgtgatgaaggcaaagctttagccgtaatgactctcaatgttaacatt

SEQ ID NO: 1025 - DNA, 636 bp, Homo sapiens
gtcagtggtctttaacttaaaataatttagagaatatggtttctacaacttacatttttgttttcttgtaactacagattattatgatggttgtaatgaagattatgagtataattggagctatatgtttctgaattctgaacaactatttataaaattttatcctacttttttctgttgaacatatgacttctctggtctgctaaacacatacagacctttagttttggtttacatggatttaaatatatagatatatcactgtaaaataaacttcaggtgtaacagatttatagagaaagtaatcatatttgtttatggttgtgtacctactttgagaagaaaagaaaaatattagaatgaacagataattttacaagtgttgatcacttaccagcaaaccagaaacttcagagattttgaaagcaaatctattttctctgctgtgtattaaattcatttatctaaaatgttattgctcctggcttagaatcatcttgtgcaaattctcttttttttgttgtttgtctgtttgcctgttgctcaccatagacataatttttttttcataaaacattctttgtataatcacctcagagattatgaaagtgactttgataaaatttaatggtgttc

SEQ ID NO: 1026 - DNA, 541 bp, Homo sapiens
gcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccacc

SEQ ID NO: 1027 - DNA, 455 bp, Homo sapiens
tctgtgtgtgtgtgtctgaagagtatcacttatatgcagtgcatatacatgtaagtgcattactttgctcaaatatcttctgacctattacagtcaactcatgcatgagtgtgaacatgtattacagaaggtcttacagccttagtttctgttttagattttatgtgctgcttcctttctcaaacaaaagcatgaaaggaaagaggataagtactagaaatattcatttttttccttcacaaatctaaatgttgcttatgaaaactcatcttagagtaatgaatatgtggaagtgggtaggtaggaggaaatgtgcctctttaaaatcctaaaattttaccattgatattgacatttgtttgcgtgtatataaatggagcatgtgtaaatatagaattccaatagcattttttattttattataaatctataataaatatatataaatcactacc

SEQ ID NO: 1028 - DNA, 404 bp, Homo sapiens
cctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaatccactatgacatctaagttttgtgtacagagagatatttttgcaactatttccacctcctcccacaaccccccacactccactccacactcttgagtctctttacctaatggtctctacctaatggacctccgtggccaaaaagtaccattaaaaccagaaaggtgattgg

SEQ ID NO: 1029 - DNA, 476 bp, Homo sapiens
atttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctt

SEQ ID NO: 1030 - DNA, 447 bp, Homo sapiens
agattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctcttt

SEQ ID NO: 1031 - DNA, 784 bp, Homo sapiens
agaagaattccattctcccatcccaggaaggagagtgccctgcgtgccacgaaagagcccaggacccacaggacaaatacgtcactggcagacctgccttcgccagcgccagccagtctctgaaacctccagcatttgtgccccggtccggcccctcccaggcctgactctttccgtgaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagtcttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggcttaagaagcctggtcagccagccaggctagtcccacatacctcagaaccagtttaataaaggctctatgtcattctt

SEQ ID NO: 1032 - DNA, 453 bp, Homo sapiens
gccccacagggtgtgggtctccactcagggatcaagagcagtgctgttgggaatcatgcatggtaaagacagcccttactcaagacagaaaaagcctgatgccacatgagaagggaagactgccagtttcatttagcattgttgcctagcggggatttcagggcgtcctgtcacgtgagaggaatggggaggcactagttgtggaaggcagagctggtaataatttagattttgtttcatagataacagcaatactaataacggtgtgatgacatttgaaggtgatactgatggccctacttgagtggttttctgatagtggtaatgtctgttgtgttgccctctttcataggtgtgaattaaatctggcaggaaaatttacatagttagaatagcaagacaaagggaatagatcatttcagaaggataagctgtacaatggtattttgaatt

SEQ ID NO: 1033 - DNA, 450 bp, Homo sapiens
tttttttttagctttattgactattaccaactttcagtatggttcaaataattaaatactgcaactgggacattaaaaatacaagctaatttaccaaaataattgtattctgaatattatgtacaatattatacattttacattacataatgggtttttatacataaaggtaagatttctgattattggaaatacaaagtacaactgaacaaaacattcctatgcgtacatacacaatcactcaactggaacaatcaaaaccatctatgagtgtggttattaaaaaataaaattacgttcatacaatggtagaaaatgaaatgtttttattaatttgattattaatacaaaaccacacatatatgaattatataacctagtgttatatatttaaaaatctttatgcttgcaactgaaatgtctctactccaagggaagtttctgattttt

SEQ ID NO: 1034 - DNA, 409 bp, Homo sapiens
cagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaag

SEQ ID NO: 1035 - DNA, 413 bp, Homo sapiens
ccccacaccacccccagcctctgggctgtgagctccccaagccctgggatgtcttcgtttgcctccgaggcaaacctatatccttagggcctgtgtccacagtccattccatactaatgactatttgtagactaagcgatgaatgaggtgggctgttcttcctgtcttcctgtgactgccccccagtcgttctcacacatgctggaaatgcaggggcacctctgactcttcccagccctccatcctgagctggtcacaagctcatgttgactctatctccaaatccatcaatgtctctctgtttcttgcaccatatctgacatagtacaagtaactttcatcctgccctggaacactcctttagcactccctgtcccttctccatacagctttcagagtgacatattttaatt

SEQ ID NO: 1036 - DNA, 531 bp, Homo sapiens
atcgttcttgcctgagaacccagggatcagtataagtgcttgcctttgtatgcgtttcactactgtggctgttgggtctcagcccatgttctatgatccaatcccaatcagcaatggccttgacctagaatactttgagagccaaagagaataaatactcatcccaagaaagttgccttctctagaggatgacaaactcatcccaatgaacacgttcatatcagcatttcaattttgtcttcacagtttttgaccagggaagctgctaaaataattaagctagcagcagccccacttttgccacattctgaccttggaatagtgaaattgtcttatgagagcttatcttatggtatttccagtggaaagacactcagcagaatttctgtgactgagacaacagtggtcacacctctctcagataaaagcagttaagatgcttgtccaactgcagtttgcaaaaaaaaaaaaaaaaaaaaaacaaaaacaaaaaaaaaaacaaataatagtagttctggcaactgctctgcc

SEQ ID NO: 1037 - DNA, 547 bp, Homo sapiens
ctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttattttt

SEQ ID NO: 1038 - DNA, 419 bp, Homo sapiens
accaggctgtatatggaggctctcctcctttctaaccctgctgctgatttggaattaccttgccaagcccctttgtgccttatagtgaactttctctaagggacctgtcatctcttatcattgtttatccattttctagattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattgg

SEQ ID NO: 1039 - DNA, 373 bp, Homo sapiens
gccctgtatgctgcccggatccccgaacgctttttccctggcaaatgtgacatctggtctcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccaggcgtgcggcacttgcgggcctccctgctggctactgatgccagtaccagaggagccccaaaactttgacagcctcgtgggctttgtgacggcccaggggctctgcgtggtacatgactgagaagagaaaaacaaaaataaatcatacctc

SEQ ID NO: 1040 - DNA, 628 bp, Homo sapiens
ccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacgggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtacagggtgagtctccttccagtgccccagtttcttccaggtcacgccaggccaggccaggccaggtggggaaagggacaccttccggccctccccagtagctggctggagatggagcttcttgtgtcccagaactcggcgtccagctccactagggcctggatccccatcacagcttgggttagccccggtcccagcccaaactcaggctggaggcagccccgaggcctgtgcctttcccactccaccttctacagttgcttagccaataaacctttcctgggctggag

SEQ ID NO: 1041 - DNA, 498 bp, Homo sapiens
caccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttaatgttgccgaaataagcaactcttaggtttgcctgactgccttatgctggtaaagaaaagggattcaactgtctcttttccaaataaaaaaaaagtcaaaatttc

SEQ ID NO: 1042 - DNA, 675 bp, Homo sapiens
gccgcctgcaggacctcgcggctgggccgtgggtccctgtgccgccgcgctgacgatttagagacggcctcacccaggagctacgcgcggctccgaggcgtcgggggccaccaccaggtagccagaggggccctggcgcaaacatttaatcctgggctgtgcggggccgaggccgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagacagccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtattttatgaaatg

SEQ ID NO: 1043 - DNA, 449 bp, Homo sapiens
aaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgatagataaacagagtctaattcccaccccaaattttgctgaggttttcttaatgttgtagagcattttgtagagtggtttaaatagttgaaaataaagttcagaacatc

SEQ ID NO: 1044 - DNA, 486 bp, Homo sapiens
atttttttaaaaagcttgatgcttaaatgcttaaataaatgcttaaatctacttttaagcatttatgtcagtgaattcaaaatactattatctttaaatcactcaaaacccattttaaacttgtatgcctttactcagttagttccaatggagtgttaaagggaggaaaagaagaaaaaattactcctaggactgagtaatattctgagctcatcaatctatctttaggtattgggaatatgcattaaaaacatttttttaccttgtctcgtgatacagctgaaggtaattctctggctagcctgtttctcctttgttcctaagaaacacaagcaaaacaaaagtgattatccaagtattgagatatatgcctactaaaaaatgttcatgttaattgaaaagtgtggagtaacttacagatacatcctctcactgttgggactcatgccataattatcatattttaaaataaataagaaatcattt

SEQ ID NO: 1045 - DNA, 871 bp, Homo sapiens
ggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttgacagacgctgtcctccagttccccaagtccctccaggtcctcaccggtccctcccagccctgcccactctggagcagcgtgcccgtcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtttgagggactctgaaatcacagaaagtgggagcttggaggatccctccatggcgatggccgtggagagaggagcttgcccttttggggtcctggttcctgaagagctcacccagagaggctcaaagcagccttttgtcccagctcagctttgatttacccctcttgcccccttcctcaagggactgtgaccctttggggattctgtccctgaccctgcttccccaagctttcctgggttttggagggatgtgggaatgaattggcattgcaggaaagacaggtaaagtgattgctgcaatgagaaggagctgtgcggaaaaggaataaaagttggaaaggctgg

SEQ ID NO: 1046 - DNA, 547 bp, Homo sapiens
gtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctacta

SEQ ID NO: 1047 - DNA, 409 bp, Homo sapiens
gtggatttgaattccactgagcttttggctgtggacccatggggacgtggcatatgtctcgctgagccttagtttcctcctgcatggaatagggagagcaatagtacctgcctcattcagctaacgtgaggatctagagcagcatttgcataaatgacgcgtggggcacagagcagactcaacacagagcagcttacgttatgaggcttggcaggctgggagctcctgtcggcctctctcctcagctctgtgcccactgagctcggcacaagggttggcccatgacaggtgtttattatgtggaaataaatgagagggacaagacatttgctgatttcttcactgtttccaactgggaattcaaatgtatctcacgttcccataccctcacaataaatctgttcaggag

SEQ ID NO: 1048 - DNA, 453 bp, Homo sapiens
caggatctatcctcaacacctagtgcaattctttttacacattaggtacttagtaatttgggttgaattgtgttgaactaacctggcggtataggcaaaatttggaagtttggttttcagaaagtcttgacttcctcttatctctaagtaattggcatgtcctctaattcatattttcccccctcatctgttgggtgaaatactgtttatcctttagtactaaaattaaaagttacctcattcttctagctagctgattttttttttaatctaggctaaatcatgaatacatttacatttaaataaaatattacagttgaaagtaaagggtcctttcattatctccacttccaattccagtaccctgtgtaaaggaaaacatatacatcttgcagacattttttaatgtgtttgtaatataggtacataaaaatatatgtgcttgttttaagc

SEQ ID NO: 1049 - DNA, 498 bp, Homo sapiens
atccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagt

SEQ ID NO: 1050 - DNA, 505 bp, Homo sapiens
agtcagggttggggagcccccggccaggtgccctccaggatccgccttccccacccctcctgggaagcctggaccagcatcccttcttgggtggatggagcctcgtcctcatctccagctacatcagtcattctctgcagggcaaaatctcctccccctaccccagctgtttctgcagaagggcccctggctgtgttggcaggacttcggtgtccagggtagatctcccctccactgaggagtgaggtcccagaatcctgttgggtcccaggcctcagccctgcacagatgtgatgtggggcgatggctctctgggaaccctctacagatctatttttatatggaacttgttcactggacagaggtggcctgcaagcccccattaccctggtctgagctcaccctgggagggagggggccagtcggagggggttccttctggagatgtttttatatttcttgggttctctatgcaggataataaaaacttgtctgtgatatggtg

SEQ ID NO: 1051 - DNA, 481 bp, Homo sapiens
ccccacattgtcagtttattctaaaattatcaccattttagacttaaagaattttaaagccaaaagataagcaaacagacttgcttaggtcctgtagcaaattaattcagaccttgaacaacatttcattgtgctgtttaggaagtgttaagtatattgagattttccatattactgtgttactatcatacttaaattttagaagatgatcaaattattttaatgactaggactatgcttatgaagttagcatttcctgcccttatttatagaaagcacttgatatatttcacaaaggtgaggagattaactttttagggaacaagtcatttaaattcttgaaccagtttccatcttttaggctatatgagtattgaatataggagaaaagagaaaagtatgcatgtttctcaaaggctctttctttaaatgtcaccagcagatctaaacagtatccataggcacctatggcaaatttact

SEQ ID NO: 1052 - DNA, 436 bp, Homo sapiens
agttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgt

SEQ ID NO: 1053 - DNA, 470 bp, Homo sapiens
aatgactttttcttttctcagtcttaggtaataatgtgtgggaatttctgactgagacaaacatctgatatttgtttgcatactgtaggtgtaaactgctggaaaaaaactggtattatttttaaaaagggttgcacagccaaatgttaaagctgaagaagtgacgttattttagaagtctttttttttttttttccttctctgcaatcagatttctcagcctggtacattatgaacagcttagtgctgttgagtaatttatatcaggatgattaggaaagcttttctctgcagattttaatttttcttaaattaaaccactggctcaaacagaattttccttgaacccaagttttcacattagagatttgcataacttttaataattcttatccattttccttttctatcccctcttacctataattctcagtctttattctttcaaaaaaggaatgaatctcatcttt

SEQ ID NO: 1054 - DNA, 388 bp, Homo sapiens
gccattaaaaatgaaatgctagctaaaagccaatgagtagttacaatctttactgctgaaagaaatcagatggactctgaaactctgatgagaatatcagagtacagcaatccttcttgagctacaaccttcacatgaagaagaaaacatgaaaactgagcacacgacagagctgatcctaatagcctaataaggatgtgaggaaatctgtaagcagaaaacgcctgtgtcatcgtcattcattctttaaaagctctgcccagtttttccgtattacttgataaagatgacgactgttaaaacaacccgataccaacttcttgagcacaaaacaccaggagaggtttaaacactgaagcttcagtgttcatctattctgaaaagttgt

SEQ ID NO: 1055 - DNA, 664 bp, Homo sapiens
gttataatgtcatattctagcattggactaaatatcaatttctgactcttaaagtagttctgtgtataaattcaacatgatgaatcaaggcaataatttctcaaatgttcttttatttctttgtttttatctcgactttttattttccattttttctagtacgcaaatagtgtaaaattgttttaatgcctggactttgaaacaagtaacaagtgtttgaaagtatataatctacgagcgaatttgccctccttggactaaccacatacaaatatgaatctggctgcaagaacaggatatccaggtaactagagagtgggcattgataaaaatatctggtggagaagcctaggatttcaactttttgtcagaggattcctgttgggacagctttaccagaaaagaataatagcggatatgttcatccaaactaagaactttcatgcatcttgcattgttacatagcctgtggaatgaattcattttttctcccttgagtccaggaatgacttccctggaaaaactcaatctatatacagctgtgccaaaatgaaggatacctgcctctccgaaactttcactgctgcttctgtcattgttcacttgtcagataaaattttattatctcaggatgcaaatttaaaataaagtgtaaatctatgtt

SEQ ID NO: 1056 - DNA, 682 bp, Homo sapiens
ggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgagctttctgagagcagcgtccccatggacagagctccttctgtgtatagcttcttcagtgaggaaggtacaggcaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaag

SEQ ID NO: 1057 - DNA, 727 bp, Homo sapiens
aagaggcgccgcgccattttgtgacgttcagcacggggcggtggcgggggctcccgcccatcggagggtttcctagtcttggagtggaagaattaatattcctcattggggcatgagcaggatgggggttacctgggagttgggaaccacaaaggggagccgatagccgagttgtattccaggtcacggcctttttatttttatggcgccttttttttttttggcccctcatttaattgggaagcttctcagaatgtttttgtaaagtcactaaccaagaccggacctttcagttcatattaaatggcccccgtagtcaccttactttcatgtagtttcagattttgcagcctgaatctaatcacctttttctaagaccgaaagatcttccttgaacttaagattcgttctttcatcgcttcccattaaaatggaggcttaagacaggtgccagcagtgtttttaaaaattttcaccagtggtttggtcttagaacttactcctgggcacagggtgtggtcacggcaaataggatgtgtctggactggatattttaattagacaagcccagagtaagaagaacgtggtgtttatggaaagcacttcagctgaattattgagtagatggtttttatgtaattgaaactggtctacaagtttatcagattcatcgtcgaagtgactcagtaataaagctttatcaaatacaagtccgccaaggaagaac

SEQ ID NO: 1058 - DNA, 950 bp, Homo sapiens
gataatatataaacaaagattgagtggcagcagagcttttgtgttaggcgtctgtgtagtctgtgcccagcctaggttcttctcatacctgaatggccttctttctcattagggctaacttacaggccatactttattgaaggaggggaatattgctgctgccgctgctctgggttggccattaattcaagttttcagtgtccctgtttcagtccagctaagtggataagggcatttatttttagttgaaagggacattttatcaactttaaagttatatgcattaaatatttaaatatgttgacttctttatccattcaggtgttgaatgtttgttttctaaaggagacaatgattcataatttgtgacactgtaaatcctgaggtttatagaaaggattcatgactttgtaatggaggtatgttttgcattttttgtattttgggtcacatctcttggttgagagtacctggaaatcattatttccagatcctggaagaatctatagaaaataatccatcttaatgctttagagaacaattttcattattgcaaatgatcaagaatgagcattgttgtagactccattatcatttaaaaaatagttgttatctgcaaagtaagtacgcttcacataaggaatctgcataagttatttcttgtgtctattattacataactatgaacaaatttatgttatacaataaatttgatttatgagattggatgtaattttattaataccaattagtgttatatatttaatgtgcatattaatatatatttataatgttataccttttttttacctttttaaaattacacttttaagagactgactttaacaatcaagtatgagttgtttaattactcctggctttaacttttcaaagtagctttattggttttatggtcataacagtaagacatcgaaatttttcaaaaattc

SEQ ID NO: 1059 - DNA, 357 bp, Homo sapiens
cttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatg

SEQ ID NO: 1060 - DNA, 472 bp, Homo sapiens
agggagtgctgtgtttgctggctttgaagggagaagaactaatgaaataaacgaggtaaagaatgtttgatgtttgttcccaatggttccttcatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactg

SEQ ID NO: 1061 - DNA, 364 bp, Homo sapiens
tcttaaaacctgaaagaatggattcctgctcccaatgtgtttttaatatcaacttaaactaaaataatttttttacctatttttggaagcttggaaattgagatgtagttgtctaatgttaacctaattaagagagcttggtgtgatttctcatatacagcatctaaatatttaagttttaatgtcttctaaaatattattacattcttcatactatagttttttaacatcctttagaaaacttgtatcagcttcactttcaaaccatgctggcatcgaactcaggtgtagtggtatcagaatgttatgaaataattttttattttcattataaactccatttttacaataaacacttctcaac

SEQ ID NO: 1062 - DNA, 1216 bp, Homo sapiens
  misc_feature 585: n = A, T, C or G
cccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggagtgagtatcgtccaccatcactgttcctgctaacgccgcctcagcctgggcctaacacacacaatttccttaggcccctgtcgctcttccccgggccaggctgcttgagtggctggtggctggtggatttacttaagacggttgtgttccaggcctacaaaaaaatgcagagaggcagggcagggctttttggaattaggaaacactggctgttattctcgggaaattttttttttccgccttaaattgtgccaacgtggtctttgggcttgggggacttaacgcaagactaaccgcagtctgtacgtcgtattataggttaaatccccttttttaaaaaactgaagtatttgtcctttgcgttcgtgnaaaaagtaaccaaataattcatgcctgtgttaatttggtgttaaactttgtaggttgttcacttattgttattgctgttatgtggttctggcccagcaatataattcaaagatcatattctttttgacagacgcttagtttagtgtgagcctgattacttaatttgtataatgtcaaaaaacgggttataaaccagagattttcctttgtttgaataatatacagatttgtgatatttcacagttgttcttgagaaggatttttataaatgttgaaatttgaattagagtgtatgactttttatcctttttgtctcacttttattttgaaaattatttctatcgcaagaatattaagtggatgaattgtaaagaaaaaatagttcaaagaagctaagaagtaagataaagtgtactactaaaacagacaattggaataataataatagtcttgtgctttttggaagacttattggtggagaagtgacaattcaaatgtcattatcagtaaatatcatatattgagaattttatgatgtcacttaaatactaaacaggaaattggaatcctctaagaatctactgttatggtacgtgtaaccattaactttctgctcaataaaataattgac

SEQ ID NO: 1063 - DNA, 582 bp, Homo sapiens
gccgcagagtttaaaatatattgatggctgtaaagggacaacttggggatattttaggtctgctgagatgatgcacagcatacatacatgctctagtttttggaaccatgtcattaagttttcaaatacatctgttttgaacatggtattttgtttttctcattagcacgaattactactctacagtttcttctagagtaaataaatataatggctgtttgcagagcgactacagacttacttagatgtttaacaaggtgaacgatttcacaattagatcaaccattgagttaacagcaaggtgtttttcatctgttttgtttactgctatagtggggacaggtaacttctccaatttattctttgttgacatctttagttaccaacagactcccaaaagtaatgaaaagtcgattaaaaagaaaattgtaattatgccatgggttttcccaagatccttaaagtcagctcatttaaatttacaagagaaaaataacaggcatcatggaaaactaagtaacaaaaagctattgaaaaatacatctgtggaacacagtggtcagttgtaaacagctcagaaga

SEQ ID NO: 1064 - DNA, 501 bp, Homo sapiens
gtggcataagaagatcctgtttttaaatttgtcaggcattttattattcagtacataatatgtatagatctgagtgctgttttccttgcattgtctattatttttaccttgtctttcccctaagagaatttgaagaaaatcttcaccaatatttctagtgttgatggtaattaggaaaatagtagttgagagatgtaagaatagattgagaagagtgagtaaaatgggtgaaatgacaagtgggaaccatgtagctgagatgtatttgtttagatgaaaagtctacactggttcttaatgtgaaaatcaaaccatgtatctaccttaagaacaatgttgttgtttttaatttattgtagcgatttagtttttttcacgtaatatttctattttctttgcagattgtttttaatttaaattgtggaatttttacttctcaaaatgtattaagtactgtattttttgaaatcttatttttaaataaatattttttaaaaacgt

SEQ ID NO: 1065 - DNA, 612 bp, Homo sapiens
tgtatcataggggatagctgggaactggtagagcagaggtactaagttccacctggaaatgctttagagtagctctttgaatatgtctttacttattatcttacagcgtatgtgtatatgattattttctagagggtcgtaccctttattaagctgtgagcttcttgagggcaaggactgcaattcattaatcattttggagaaaagtgaataattctgaagaattcggtggttcatgagcttgcctggtatttgtttctctatggcttatcatctaagtgagataacagatagtagataattgataaatttaatctgttacctaattactgagaggattcgattcttgctttatgttattactgaaacagactgcccagtaatcttctctagagagcaattaggtttgcaatgagttattttattgagaatgctacttgaaattaaatgtttatagcactatcttgatataatttaaatataatttaaatgtgctgaagtatcttcattcagataacttgttaccccttaacaaaaggctgcttgagtattgtttctctcccatttggcaaacaccagatgcagtgattaataaaggtcattatgctactt

SEQ ID NO: 1066 - DNA, 394 bp, Homo sapiens
taaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaa

SEQ ID NO: 1067 - DNA, 471 bp, Homo sapiens
ctaagcctctgcttatgcatgaggtataatgctttttatatgttatataatgctcttacgcgttagctatctgaatgatagatttaataaaatatacctcataatattatggggaaaggatgacgactgttatagagaggaacttgggagtatcacttctgtaatccttatctaacctgaatctgttagcaggaaactgaaaaggcctgtgtatgacaatgagataaacaattttaatctcttagcaatgtcaagtggaaaatctaactacctgccagtagtttaagaaatggctaagagattttgttgggcacaaataatcctgagacccagattgctgagccaagggtaggaaaattggttttgctatgtgttacagctgggaagtgagaaggtcactgtttgacaaactactaaaaaaaccttatggattaaacattcgccagtgtaggggacattttgaatgtgtta

SEQ ID NO: 1068 - DNA, 815 bp, Homo sapiens
cagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggagctttgggcctaaaagggcagccctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccag

SEQ ID NO: 1069 - DNA, 700 bp, Homo sapiens
gcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgcactgtttttttgttattgttctttggttgtttttttgctgaatgattttatgttttgggaaaaaaagtacgctttgctgaataaaagcaaaaaacaaaacaaaaaaaaaaccacatcccagac

SEQ ID NO: 1070 - DNA, 905 bp, Homo sapiens
tatctgttcacagagtaaattaacagaagttattaatttataatttgtcttataatttattcacatacattattttaagcaacttagttcatagttggatatcctaatttttattaggtagtaaatacttcagttacttaaaattcattttattattatatcatacattataaattaatagtttagttatttttacagaagtctactttgcctttgtattttctggaaaccactctgccttgtttgatagtttgacacgtatttaaagcagaaaattttaagtgtaatttagtaattgagctctgagtatgttcttataataagatgatttttttttctgtgttttattttccgcttgaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagc

SEQ ID NO: 1071 - DNA, 447 bp, Homo sapiens
acatggctgaagctgtccagctgcagagagtggtggggcctgactggacatccatgccgaatctgcaccctccaatgtccccctctgctctcaaccccccagccccaacctctgggtccctacaaagcagggaagggacccccggggcgtggtgaggctgcagctctccaggagttccacacgggcccagtgctgcccctgctgctgcaggagcccccaggcgaggttcggccttcctctcgcccctgtgcacccggagatgcccacagcaccagcacctgagctcacctccgaacccgcctcctgaacccgcctcctgaacctgcctccttacctcccacttcctgagccctgagtggaagcctttctgtgccttgccctttgcccactcccctggtgggactgccaagaccctcaatgcccattaaatactcttgcctgcctctt

SEQ ID NO: 1072 - DNA, 426 bp, Homo sapiens
gctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcatttt

SEQ ID NO: 1073 - DNA, 467 bp, Homo sapiens
gaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttca

SEQ ID NO: 1074 - DNA, 446 bp, Homo sapiens
gcgggttcatgcgtcccccgagacccaggccgcgtcgggggccaagagcccttacagccttctcccgcgccgtcgggaggtcctcccggaactgggccggagcgcagagaacgcagtgtgagaagggcccatgggttttaggtcacctccttcgcgctggacgcgggcagagcggtgtccctttctgtctctgccaagagacgtggagggagggagaagggaggatggcttgtgctgaaagaaacaagaatgaagtcgggcagccgggatctgagaaatgggaaatccatggcccttgttcgggaccacaggctttgccgacgtggtctctcctagttccgaaattgcccaggcccgcctccccaccctctgcaagcagcgggaacgacttccacatcgcttaatttctttattaaacttttcacctattctcttctaaaggacag

SEQ ID NO: 1075 - DNA, 656 bp, Homo sapiens
tatttgtacaacagatgtttttattataacagtaatttacatttaactttaaagttagtgaagcatactaccataaatgcacaattatgaaaaattagaagctaaattacagattcattgatggagtcaattatgcaaagtggtcagtggttgttgaagcatgcattgcttcaacaggatttgcgtgcatttcccatgatcctgcattcttgtgttcttgatagcatacagacttactcagaatcaacagttgctgcttaatttgtctattttgtaagcttaggctactattttattaaaactggacatagatacttggctgaatacaaatagttttgcagattgcaatataataaaggaaacagtaaaaactagtgggctatgcttgggtttttcttgaaacctaacattgctttaggctgggtgccgtgcctcggcctcccaaagtgctgggagccaccgcgcccagcctggtttgaacattattaagctgttgaatataaacttgaaaataattttctatgatacagctttcaggtagaaaaatgaattttcgttgtgtttaacaatgttgtgtttaacagcttatacaaataacacagtataaatggtaattgccactgtcattttaaaaatcaaaaaatagtaaataaaag

SEQ ID NO: 1076 - DNA, 441 bp, Homo sapiens
agatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcatttta

SEQ ID NO: 1077 - DNA, 414 bp, Homo sapiens
ctggccctgggaagacccagctttgagcctcaggttgtgtctaatcatctctctgtccttgggccagtcaactcacctgttcgtgctgccacagagacagaggggccacatcagagagaaagactctacagcttgcccagagtcgagcttaaatggagcagcatgatttttgtctgaaaagtctgagatgggaccagtggaaaggtgtgcattttaagaaggatttgcttccccatcttgtgctttctgtgtcttgcagcacgacctggccctccacctaggaatcataccttcatcccccatactcataagcatcctcattcctgtttccttgtggatgtcatggtctgctgtgaagtctgcttggtgacccgtccagacctgacttggtataaatgattttgttgcagagaa

SEQ ID NO: 1078 - DNA, 745 bp, Homo sapiens
gcagtaaagacaggacgcacccatgtcacaagaggagcacaggcaggggtgttggtgttggggcagccctcagggtctccagacccagccccactcacacagcagcctaggaaggaagggcagagtcccaggtgtcagctggtgggtctcccaggagctgcccctccctggaagtcacaggacaggaatgacagatcagggaactgcaggaagctgccacctctggggtcagaatatgcccagcctgcgggggctctctatcggggtcttcgagagccagacagcctgccttgtgctgcatacctggctttgctctgtgcagaacccagcacacgtgattttgtgtgacatgccagcagcctggctcccaggacaggaggcctgccctgggggaggggctgcaggaggagggggggcaggcacccatgagtctgtccagccttgtcacagatgcatcgcccaagctgcggtcctgatttcagctcacctcagagtaaatcagaataaactgcacccagactttcacgaatgcatgttgacgctttcagttcacccctttctttgctaactttcttcctattttcttctaatgcgagagcttattaattccatatttatcattttgaataacttttctcctttttagtaacaaaatgtacttcactcttagtaaaatgtatttactattttagtaacaaaaatatacttgcctaatcatgtttaaaatatagtgatgtgaaaaatt

SEQ ID NO: 1079 - DNA, 422 bp, Homo sapiens
gtacaaaactttgtatgtaaggaagattttaattttctctttatacaagctgagtcatatttaaataatttgatgttggcttagataatttcagatagattttatattctggatttgtgtttttgttaacaaatatacaaagactttggtgatcactttgcaaatatttgttaatccttgagtttgagaacctgtcttttaaaaataatattttgtatactaattaagtgtaatggaaatcacaattttaagtctaggaaataaagtattatatatactttcaaacaagctagcaaggcttttattattacttttttatttgaaatatcttatatatttggttagttctgtttaacttgtttttaactgttgcccttatgagttattttatataaatttttacaataaaataatttgatttt

SEQ ID NO: 1080 - DNA, 423 bp, Homo sapiens
ttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctc

SEQ ID NO: 1081 - DNA, 466 bp, Homo sapiens
gggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggc

SEQ ID NO: 1082 - DNA, 406 bp, Homo sapiens
aggctgaatgctatcccagtgattgtacgtgccctgtttgctgaatctactcatccttaagggtacatttgcttccaggtaacatgtttgtgagtaatactacaatgtgcatatatctattccatgttctgctttgtctgtttgggatatttttcatacactgattcagtaccatgtgtattcccttgcttttgttgtctcatccgttgatgctacgtcccccaaattattgccacgaccagttgtaatgaagcttcacccttctgtattgtgctaggaattttacagctataggttttacattatagtcttcattcattttttaaaattgacacatgtaattgtgcatattttggggaaacaattatatatatgtgttgtataacaataaaaatcagtacttcta

SEQ ID NO: 1083 - DNA, 586 bp, Homo sapiens
ctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgt

SEQ ID NO: 1084 - DNA, 443 bp, Homo sapiens
aaacaggctaggtagtttgtggaattctcctttgcaggtgaggggagaaagcagctatctcaagggcacagctacagattgggagctggggcttccatccagggtctgggacacccaaaccttaggcttgcccctcccgggaggcctccccctcagagctatgtgggatgcagttgcctttttacctgtgatgagaaactggtgaattgccaggattctggctctggcttcagtctgcccctttccggggattagagggcattaaccctacttcctacagccaagcagctcttcctcatgactctactttctaactccgggggttgactgattgatttgaagaccgccttgttgatgaatgtgttgaaacttgctatcataatgtaaatgctccttaataaaataacaggacctggtgggttcagttgccttgcccacgtgtg

SEQ ID NO: 1085 - DNA, 456 bp, Homo sapiens
gatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgatt

SEQ ID NO: 1086 - DNA, 748 bp, Homo sapiens
gtgaaggagatcctcctccggaaggggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggat

SEQ ID NO: 1087 - DNA, 868 bp, Homo sapiens
aatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatg

SEQ ID NO: 1088 - DNA, 440 bp, Homo sapiens
gggcatttttcatagtatcccatttgccttgtaagttatataaagtgcatgattataattttttccttagaaatgcaatatttagtttcatccagctcttatgaataataacctcatagattcctgatcttaatttaaataggtgctttaattttacagctttcaaaagtagttactgtaaattttactcctgttaatgctggattggtttaaaggatttataagggctgtgtttgctctttacaaggcaagatgccatacagtgttcaataatagaaggtcttgatacaaccgacattttaaatattctttatacatgaggactgcgtctttttcactgaccctatgatttcactgtgagtagggtgaactggactgcatattagtttatttgttgccataatcacatttttgaaaaataaatttaagagttttttctt

SEQ ID NO: 1089 - DNA, 493 bp, Homo sapiens
gagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaa

SEQ ID NO: 1090 - DNA, 455 bp, Homo sapiens
ctcctgttgataagattattgtcactgcaggtaaatggaggcttcaaatagaaatacatttcagttacagaaaaaaaaattatctttgttacacatttgagtttgcaggcctaaggttactcccgctacactatcatctgtaaccataacgcactcaacattttaagctaactataaggattgttgcttcactcaaagatcctgaggttttattcactaacatttttatttggtgactatagttgacaagaacaaagctgtggggaaccaacaaacactgcaatgcctggcattgtcacctcactagattgtgaattcctctgggacagggtccgtacattttcttagaatccctcacttagccattagcctgcacagtgcttgtacttagtaagtgctcagtaaatgtttgtggaatgaatgcatgatgaacaaaatacatactgaggactctt

SEQ ID NO: 1091 - DNA, 460 bp, Homo sapiens
agagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagagg

SEQ ID NO: 1092 - DNA, 731 bp, Homo sapiens
tgactttttagttactggcccagctgggattagaacccagctctatcctgtattattatttccaagacttttatttttgttggggttaattgctaatattctgtacaacttcgttttagcccagtcttgcatataatcatattttctgcataaataagataagctagagtttgagtgagcacatagtgaagaatattgactatttgtttttttctttccaattagttagggtaaagcaagtgtaaagggaagtggatggtaaggcattttgaggaggcaatcaaatatgtttttttctaattatatatttccaagccaataatttctttgaagaagaatgttttaagcgtgtttctttaccatgttaggccagtaggtacagagaaaataatattagctctttatgtcagcataggtaacaaagccttaaaaaattcacagctgaatgcaacagtgaaggccgttgacaagagaggttgcattacttcaaccagggctactgcagtgaaccaaaaaaagaactgagttctaggcttccatctccaggctacatcttaactgactaagagggcagtttagctgtccaggaagaactcgattgctaactctcactgataattttgcaacagtgacaataaagaatgaattttaaaaagaaaaacttgtctccctgaactattgaactccagaaaaagtagtacttacagtctttgctttaagagaaaccagtt

SEQ ID NO: 1093 - DNA, 603 bp, Homo sapiens
gactaaaggtgcagatgatcagtctaaacagcagtggtgataagcagaagaattccttataattggtacagtggggttatctaacagggacaggaagggcactcactgcatctaatgaggttcaggaggtaattgaagtgtgttaaatggtcaaaggtgagacttcagtttgagcttcaacttcacttataatgacttgaaataatgtaataatgtgccatattacttagaaataacacctagctgttaagtgtcacagcagcttctgcagtgatgtgacgttattgataatgagcattttctataagaggacattggaaactgatgttgcatactcattcagaatattgtttttaatgttgaagtgaaaacacttgtacctgtaattttagtcaaaaccaaatataatgttggtctgttaaaattttctgactcaaaaaaaaaaaaaaaaaaaaaaattttctgactcacgtactgagttcaaatacgttctgggtcaggcccaagttgtatacttggagatattaatgtaggtatgtgacagatatatactttgccgtacactgtttacatcacaagtgatcgcatgaaaatattgaatgt

SEQ ID NO: 1094 - DNA, 402 bp, Homo sapiens
cctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagctggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatct

SEQ ID NO: 1095 - DNA, 464 bp, Homo sapiens
catacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccacc

SEQ ID NO: 1096 - DNA, 417 bp, Homo sapiens
ggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttgtttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattacaa

SEQ ID NO: 1097 - DNA, 458 bp, Homo sapiens
acagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttctt

SEQ ID NO: 1098 - DNA, 657 bp, Homo sapiens
aaaaaggaaaaggccagggcaagtctcatgggaagaaacagaagaaaccagaagtggacattctcagccccgcggccatgctgaacctctactacatcgcccacaacgtcgctgactgcctgcatctgcgaggcttccattggccgggtgctcccaaaggaaagaaagggagaagcaagtgacagcatttcacaacacatctctgttacagacaacaggacctggggaagagaagtcaggataacacaactgttgccagcaacatagactttactccagacgacttgagatgcaaattaagtgtgcttttctgtgatggtggaagatcaggaaatgcaccttacttcctctgttatgccagatatggttagccactttggttttttaggagctataggatgggaaaagcctgagtaattcctacacagtgtgctgaaattaatagaactttcagaaattattataattctgggtcaggattaaactttgctctcagaaggcagttctagttgcattaattgttttcttttgccaaagagcgtttgtcatttagagaagacacggcaagaaacactgggtttccttaggaacattcctctcttgggcaccatttccttttttttttttaatggaaaataataaatactttgtttctat

SEQ ID NO: 1099 - DNA, 706 bp, Homo sapiens
gcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctact

SEQ ID NO: 1100 - DNA, 795 bp, Homo sapiens
atctcttaggaccactaaaacttaggcctggggcccacccatcccaagtagatgccttcctcacctgggcaaatgggttaatcatcaaaccctggcattggctgagctaaaagcaaactggcctgcagaatgcttttggagaatggacaaatgctggcctgggagagggcattcagccctgcatctctctggaacagaatgcaaggcaatagcttatgtcaagaaaaaattcactggccccttctgacttcctttctctaaatgcctattgcataattcccattaagactcaagtgttttgggtttgttcactgcagatgacacagggggacctatggaagagttggaaatgaagcagggaagagtgagacacaccttgaacttctagactcctctccatttgtattcaaaccataaaaaccctagatctatgcaggtcccaggtccctgaaatttagaggaaaccagaagaaaatttgaaataccctttcaccagggcaagaaaaacataaggaatgggatcctgattgcaaagaaccattctaaattctaaaaccactctctgaaaaaacctcatcaagagatggctaggctctttgaagttccccacagctaagaaggaataaaaaggaagagagacttagctgtctcagtcattccttagaggccttggataaccagactattctgggcaatcagtataatttagtcttccaaactgtgtttttcccatctcctgtggtccaaaaaccttgtaacagaaagcgattgaactccttcctaattctaggtctc

SEQ ID NO: 1101 - DNA, 488 bp, Homo sapiens
gaacattccaacttctatgcctttgctcttgtgggctccctcatgtaattaggataatttccagccaggtattccctcacccttgttttacaactgaatcccactttctctgggactccactgcttggtcactctgccctgtgctttgagaggaggttgggtggagcatgggacatgggccatttactgccttcacatttccctggtcacggtgatttttttaggggtgggcacatgacctaggtagagccaatgaagtgcaatatcactagaacatgtgagaagagaggcatgaaaccgaagctgagagggtttgagatctggagctactccttcctccacccaaacttcagaaggtgaaggagatagtgcatgtgagtgagcagatcccgagggcactgtttgagcctcagaatcaaagcacttctgaagctagtcccaatcttggattcgacagttacaagaaccaataaattcctttccttgtg

SEQ ID NO: 1102 - DNA, 610 bp, Homo sapiens
cagtcagctgaatttcacctcttgggcttgagtacctggttctcgtgccctgaggcgacgctgagccctgcagctgccatgtacgtgctgccgatggtcttgatcttctccacgccgctgaacttgggcttcagtaggagctgcaggcaagaaggaagcggtgaagcagccgccactccatagccgtagccaggctgcccctgcttctcaggaagggtgtggggttccctccacccatcgccgcctctcgcacacacgtctcatggctgccctgccagctgagcgcatgactaagcatggtgaggacatggcccttggcggctcctgctcttcctgttgtctccgtccccacactgtctccctcttcccttccatctgtgtctgcacagagcaaacacagcattatctacacaggaatgtagattctttgtctccagcaaagaattcaacccaaactgatttcctctgtttggcttggttgatagcgtgggcttagttggaaatgaagctaaggggcctgagtctaatcttagcaagctgcccatcacagagaagatgccaacgaattatttgctgcataaaacagaatgaaaaagaaatgtgtaccttt

SEQ ID NO: 1103 - DNA, 770 bp, Homo sapiens
cttgaccccaggaaccgggttcccgtatggaactgggaagaaaccgcccctgtgccagctcccgcgggccctcctcgttccctcccagcctccatggccgccctctagagcctccctgctgtacggagctctgggctccacctatttgcaatgttactctgaagtttctggtgctatttttgtgttgtaatgtgaacacaggcttccttgattttttttttttaatgggggtattgggtgggacagacggggtcagggaggccccaccatggcttgtcgagggcacgggcacctgcatggcggcgctctccctgcctcccctgccgggctgcaagcctgaggtctgtgctgccggacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcag

SEQ ID NO: 1104 - DNA, 651 bp, Homo sapiens
ggaggttgcagtgagccgagattatgccattgcactccagccgggggagcaacaaagccagactccatctcaaaaaaaaaccaaaaaaaatcctatttagtacaaggtacattatttaggtaatgagtccattaaaagccaacactttccccactacactatatgtgtatgtaacacaactgcccttgtaacttcctaaacctataattaagaaacaataaaaggcaaattaagaatgcttttttaaaaggtgggggcattatgctaataagttactgtggatttcagagtgcagagtagaaagatcacaagaatttagtgtggtaggtgggaacagaaaatgggtgtataaattttattgacgtgggagtactggatattgtagagacagatatcatcagggcaaggagattaaagatttttgcattgacggtttgacactatattgtggtaataacactgtatgtgttgggagatagaacaggaaacatcttccctggaatatgtatactattaaatgttttatcaaacttttgatcaaacaagacagcacaatttataatttcatttctatttctatgttatgagaaactgatcatttattcaaatgtttaacaggcatgttcatgttactataaactcttctgtttc

SEQ ID NO: 1105 - DNA, 478 bp, Homo sapiens
ttctggaacctgctcgtctaaaatagtcaatgcctttgtaaagactcagcatattcaatatctattgtatggtagctagctatatacatagattgactatttttagtcctggtttgtgtattgttgagctatagtagtttgctttatccatttgtgggattaaacaatactgtttaatggttgtaaacttttataaaatctctttgggttttttgtttgacccaaacataatgtaagtcttaatgacaaaatacacaaagttaaccagaggtgagtgaaaatatagcccttccccagttttgtctgcccctataatgcacgtgcattgctttgtaatatgctctcgctagcatgaatgtgctatgactacttcatgaggttttgtttcacctataattgtgatggaaaatgctgtattgctgacaacaatgaactgtaaccacagttatttactgcataaactatttgtgtactaacc

SEQ ID NO: 1106 - DNA, 586 bp, Homo sapiens
tggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatggg

SEQ ID NO: 1107 - DNA, 532 bp, Homo sapiens
gtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttc

SEQ ID NO: 1108 - DNA, 607 bp, Homo sapiens
gacctttacatttgatccaaccctatcaaataatgaacttctcagagaggcatctggggtcctggaacttcatgttgatgaagtcatattatataatatgataaaaatattctcatgcagtattttaaataatttcaaattctagaagaagcaaatttcagcgacatgtcattgagtttttatttggtaaagctataattgtgcagtgtacaaagcactttttaaaaagatagtttattctgtcagggtatatgaagttagtatacagccagaacagccaagcctcaattcttgtaccttgtgtctttttattactgtttaatcaatagatatcatatgtttatgacagtttcaagaattgtttttaaacccaaacttaattttatgtttcagactattgttagaaaaacaaaacaaaaaacaaaaaaaccctcactaatttgccctaattggatagggcaatcagaacaaaatctgactttcgaatatttaaaagatatgtaagtttgattgcattttcgtacattttaagcaaactaggttaacaacaacatagcctagtcaaacttctcaggaaacttgttttaataaatatgtaaaaataccc

SEQ ID NO: 1109 - DNA, 525 bp, Homo sapiens
aagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaact

SEQ ID NO: 1110 - DNA, 474 bp, Homo sapiens
tcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactggg

SEQ ID NO: 1111 - DNA, 477 bp, Homo sapiens
cagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtg

SEQ ID NO: 1112 - DNA, 679 bp, Homo sapiens
tttgaacaactgtgtacagctatctttgcattttaaatgcccctagtttgagactcgggagggtcaagtgtccccacccctggaaagggctcggataggagggtgcttgcttctaaatcctgatcttctctatggggttggctggaagagaagtaggatcttgtctgaaacctcatccccagcattgtgtttggatgttcgtgggatccgagggctggccgggcagacagaagggaagtgcgggtcttggctggcagctgggagcagaggaagggagagcgttggaggtcgtgatgtgcgtgctctgcctcagtaggtctgaggtgcccactgttgttatgcttagttttattagattctctgtaacaacatgagcttaccaaccagccttgattttgagattaaataattgaacagattaactgggcactgaagtaaaattctacctactttattctcttagtaaaaactatacacacaataaacaactgtcaaggttgccatcatatttgagttttgtcacctaggaaaacattgtttatactttgtttttgaaaaaattcatatgaatttcccctgggaataacttgttttatttcagtttttattttctattgaaacacttgttttctagtctaggattttagccaaatagaaaagctatcatttaatttggggg

SEQ ID NO: 1113 - DNA, 479 bp, Homo sapiens
gcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcccacca

SEQ ID NO: 1114 - DNA, 613 bp, Homo sapiens
aattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattacgttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttc

SEQ ID NO: 1115 - DNA, 391 bp, Homo sapiens
gaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaatt

SEQ ID NO: 1116 - DNA, 481 bp, Homo sapiens
gagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacag

SEQ ID NO: 1117 - DNA, 398 bp, Homo sapiens
agttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctgtataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaatct

SEQ ID NO: 1118 - DNA, 680 bp, Homo sapiens
gtccggtgtatcaggtgagggggcagtagtgctgcccacaattcatgaccatattaactacaacacctacaaaccagcacatggggcccactggacagaaaacagcctggggaactctctgcaccccacagtcaccactatctctgaaccttatataattcagacccataccaaggacaaggtacaggaaactcaaatatgactcccctcccccaaaaaacttataaaatgcaatagaatgcacacaaagacagcaacttttgtacagagtggggagagactttttcttgtatatgcttatatattaagtctatgggctggttaaaaaaaacagattatattaaaatttaaagacaaaaagtcaaaacaaaaatattttctaacttgtaagttctatttaaagggggtgggggggaatcttgggaacgttgtggggtacaagccacaagttaacttgctatgctgccagaagggatttctggtataaggttgaaattgctgagataaaataaactaaaacaacaaacatccttaaagaggtagggtgtgggctgctgagggggcaagagggatagactgaatctgtcattttttagaagatgcttcataggacacaggactatccatttctacagacatctttcttaagccgagagctgtctttgcagaattatcttatt

SEQ ID NO: 1119 - DNA, 529 bp, Homo sapiens
ctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatc

SEQ ID NO: 1120 - DNA, 1256 bp, Homo sapiens
aattgcttgagtccgggaggcggaggttgcagtgggccgagatcgtgccactgagctccgacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagc

SEQ ID NO: 1121 - DNA, 496 bp, Homo sapiens
catgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaatt

SEQ ID NO: 1122 - DNA, 504 bp, Homo sapiens
ccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 1123 - DNA, 695 bp, Homo sapiens
tttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacact

SEQ ID NO: 1124 - DNA, 535 bp, Homo sapiens
taagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatattgagttggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgctgg

SEQ ID NO: 1125 - DNA, 444 bp, Homo sapiens
ttcagagtcctttagttcatcatttccatcttgctcatgtgcctcttgattctccaattcacagtccttgataaaagcatcatcttccacagaagcatctccactcaactcatctgcttcatgttttttacctttgcctttagttggtttcttgtttggagtatcagttgaaacagttaattcaatattatctggatcgcctccttcctcttcaatagcctgcttgagtcgggagatgagcacggtcttgactccggtgatgtctaagttccgccgcttcagctcggacttcagatcgatgacccgcagatcggtgatctttttaccttccgcctgacccgaggcggccgaggctgccaccgcaccggtagcggcagccatcttagaagagcagcgcgctgccgaggcagcgagtgggctgcagggcggcggcagcagcgccaa

SEQ ID NO: 1126 - DNA, 427 bp, Homo sapiens
ataactcagggctggagccttcagccatattaacatacattgacataaagacctttgttttaatatgaatgattccagttaacaaatggagaaatagttgtttgaaaattaatatttagcttctcaaaagagactcctgtttggaagcaaattgttggtttaacaggacatactttagatatttgaaaaattctctgtggaatcacaatctcttatttttaagaatgtaggaatatgtgttctatatgcttttaagttatgtattacatactattctctaaaatggaaatgtttatttggcttctaaaagtcatttgtgagttgatgttatttaaaactgcttttcagtcaacttattctttataaaaaagtttgttcaaatagcatgtttttattttgtttctaaataaattcatgtttgataata

SEQ ID NO: 1127 - DNA, 1272 bp, Homo sapiens
ctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaacccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttg

SEQ ID NO: 1128 - DNA, 431 bp, Homo sapiens
aacaacaacaaaaaattgtatcattttaccaatatccacgaattactgatcacagtttgtaaataatttgtttaatatcagaaggccaaagaaagtcttaaaattttagctattgactctatggtgacttcacaataagatttctgtgcaaaaaggtaaggtgataattgatctaatagactttttttttttttttttttttgctgtccatgagaattagacttcatattagcttcaattaaaaagctcattccattttattaaaatgtttgtaattgcaattttgtgtttaatgtttactttgtctttcctttctttagcatttaggtgactgttcggcagtttgatatatggccattgtcggccttaaactgcactagtaacaagcatggtatttatcttgtattgaaaataaaacaaacttttgataa

SEQ ID NO: 1129 - DNA, 1044 bp, Homo sapiens
ctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaa

SEQ ID NO: 1130 - DNA, 1183 bp, Homo sapiens
gaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgtctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtgc

SEQ ID NO: 1131 - DNA, 1306 bp, Homo sapiens
ccaccttctagggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcaggcagagagcgaccagcaggctcctcagccctctcttgccaaaaagcacaagatgttgaggcgagcagggcaggcccccggggagggcaggagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctggggcctccacctctgtgcagggcacagaaggctggggtggggggaagagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcatttttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 1132 - DNA, 885 bp, Homo sapiens
tttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccacctaccatctcgagaaaagagccgcactgatcctgcagttctttataggccggaggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtggtcatcaagtacagaatgcaatttcttaatgatttatctgatattaaaagtatttatgatctct

SEQ ID NO: 1133 - DNA, 876 bp, Homo sapiens
tgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacgtacttgagtttaaggggtttgtgttgtttgaaggttcaatgcttgcatgtggttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactccc

SEQ ID NO: 1134 - DNA, 780 bp, Homo sapiens
aaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatag

SEQ ID NO: 1135 - DNA, 609 bp, Homo sapiens
ggtctggagatagcgcgagagactcaccggctcctgggaacccagtcgagggcccgggccaggggcataagaggaagttgtcccgagtggctcgcctctggccctgggagaggcggccccgggagccggcgtcccgcccccggcggcctcattccccgaccctcctccccggctgcgcgcgccggccctggctgtatctcgggggctgcggcgggaactgccgagcgggcttgactggacgcactgcctgaggacctgcggaggagacgagggagcgcggcgggtcagccccgaggttaggccgcgggtcccctgtccgtggcgctccgtccttttcccagccgtcttggctacagaatctgcgacctccccacactccttctcttttgagtatgtcacttaagtcttctcgccggatgctttttcctccttgcttttgccggaaaggagagagatacatgtgaaggatatctgtcctcgttgcttcccctgccctctcaaaagtttaacttctgtgggaatgtgtatcttccttttctggaccatttgacagtcccgccccagccgccgtgtgatttagcaaccggtatcatattcagatcaaatctt

SEQ ID NO: 1136 - DNA, 519 bp, Homo sapiens
agcacacaactgctaagtttgtacttttgaaagtaaattattctttgtttgataccttattttttaagaaagtgggattaaaaatattttggtcagtgctgttttctacccaccttcaaaagccaatggtttgatatttctattaatttgtgcttcctttagttttaataggggatagaagactgcagctggttgggtctggaaaacattaatctgggcaaacggagctggagctatgaggatctgagtcctagggggccctcattcactagcagtaagaatttaagtggtgcatggcacatagcactgtactagattctgcaggggcacaaacatagagccaaacactctccctcttggagaatttcagacccagaaaaggccacgcagttctaacttttgtcatcggttccttttgctaaaaggcaaagggtatgttccttgcctattgtccaacataccccttccaagattgtgagaagatgggtagctgggcatcaataaatattgaatcaattg

SEQ ID NO: 1137 - DNA, 474 bp, Homo sapiens
tcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaagg

SEQ ID NO: 1138 - DNA, 880 bp, Homo sapiens
ttaaggagtggggataatgtccacggtggcccagcctcttgctgatggcaccttccctgcattgctgcctcccgatgatgtggttcttttcttgtgcctgtggtgttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaag

SEQ ID NO: 1139 - DNA, 449 bp, Homo sapiens
tggattatcttgaacaacaagatgacatgcttctgtctgataaattggtattaaggaggcttcggaccataataagaaaaaaacagaagatccaaaataacaaaaatcattaataaggctcttaagtatttcagtgtatctgcatctttgtgactatctgcagtgaaactttgcttgtttgaagtcctgtggattccaaagccaaatacattttataaatgattttggaattagatgtcagtttggattacttaaattacaactctttaatgttgactctagtcattgggcattgacgtgtaacttgtctttctactgtttctaatatctattaattagatcataaggtacctgaggccagggatcttgtgtctgttgtgcctgaatttggcgtgtctaataaaggcccatgcacactataggcactcaataaaacttacatttttatg

SEQ ID NO: 1140 - DNA, 452 bp, Homo sapiens
tatagaggaccccctgcacaaagctggatgttgcacattttgtaccgcatgctttgggatcgacttttatcccacttgtatctagtgacaaagtgcacgttactgtgatcaatttcagctgtctactagtgactgtattgtgatatgcatcttgtttcatttttcacttactaatcaaaaagcctgctttgcctctcttgactagtttgtgttttagatgtcatcataatttgctgaaatatttatgatctagcatgattccttatctgagacttcttgctgccttttcacagcactattaagaattgcttcagtaactgctgtcctaagtgattgttgagaatgttctgaatttcgatgcttattttattaccccaacttcaaatagaacttagccatttgaacttcctaacttcctagccatttaaagacctagataagttactttatgc

SEQ ID NO: 1141 - DNA, 477 bp, Homo sapiens
cagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaag

SEQ ID NO: 1142 - DNA, 764 bp, Homo sapiens
cgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggcccaaaatgatggcccctcttaacccaaggcaggggatcttcctcccaactccctggaccaaggtggcatttcctgcacacccctccaggccaagatgatgctcgctctcaactctgtaggccaaggtggcgtctcctcttgactctccagacctaaagtgacacccttcaggcacttcgggcccaattcagcccagtcctggtgctttcagcgccagatgacagcactttgcagataagaacgatatgatgtgtggatttcactacatttggctcctggatgctataaaaggacttggatttctgacttggctcagggactggggttagcagtctctttctgctccttttcacctgtgttttcttccgatcccagctctggtccctcagccgcattcatatttactctcctctcccagcctgatatccctgtccctcatctcaacccgaagccaagatctgagcccccaagatggagaatggggaggagctttttatggcggactgattaaaactcttaagcattt

SEQ ID NO: 1143 - DNA, 778 bp, Homo sapiens
cagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggcgctgctgccctgccgctcctcttcctggggtgtcgctgctctggacggtgctgttggaccccggcgccgtctccgcgtggctctggagcctcacctcggagacgacgctggtcgcctggctacacgctgtccccgctgctggagtgcgcgctaacggctgctgccaacctaagtgccagccccgcgcctggctccaggtggactccagggcaccggctttatttctggtgcactcctctcctgagagtgtagaccaaggtcgcctaataaactcctcaagggatg

SEQ ID NO: 1144 - DNA, 567 bp, Homo sapiens
gcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggagg

SEQ ID NO: 1145 - DNA, 981 bp, Homo sapiens
ctcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgc

SEQ ID NO: 1146 - DNA, 576 bp, Homo sapiens
cacacacccttctaggacatgttgattgccaactgctctgtgcagctttcccatagctgtctgttcccgtgcatttcggagcaccaagcaaatacgagcagagagacctggaaaaaaaaatgatgaagacagtattaatgataaaattaacatggctgagtgaattgtcaatgcaagttcctttactaactctttgttaagttttgctttgtactccttacatcctctttctcttaagccattgttttaatttcttctcgttatcatttttaaaagtaacagaaatacagctttcttcctaccttcacgattgacttggtggaggttgggttgcaaagaggaagcagtaagaaaaaataattattctatacattcacaagtccttcaaggcacaaaataaaagtaagaaatagaaaatatgtcctttctcctaataaaggtctttataataaaatttaaatgaagttttgtgtttcataacagcttcccaaatactgttgtagatactaaaatgtgcctgtatgtatttccttccacaataataatagtaataataaacttttttaggtccaaatt

SEQ ID NO: 1147 - DNA, 528 bp, Homo sapiens
ctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 1148 - DNA, 604 bp, Homo sapiens
cttgggccctactcgttgtggttcagcagctgtgtaatggagcaaaaaggaatagtcactaaacagcgaaggaaagtggtggaattattaaaagacctagcacttacctgctgggatgagtctctaaccccacagaattgatttcaaacacaggatcttattcaagataaggataataacagctatcttcttgggttgtaaaaagtagcattagactgcattttaaacatttggtatgattttgaggacataaccgtaaacagctatttaatactattccaggtagtcaaaggccaatgtataaaagttaaaaatataggtcttgtcagctttttaagcgtctgtcccactgactaccatatctctacaagagaatagatgaggaattgaggttatgtgggaagtacgtgtaagtttacagtattaagaaatgtacaataaaatttgtttctatgtcagcgtatattcttgactcaaggagtttgaaagtgtaaactcaaaggtctttcacatgtaaagaggaacctctccattctgtacttgtatagtcattacctcatatagatttaattttattaaattaaattttacttattttgggttt

SEQ ID NO: 1149 - DNA, 428 bp, Homo sapiens
ggttataactttggctctaattacttttagtaatggtaagacaacgtgagttttgtttgtttacatgctgtttacaatggcataatttaaaaaatatatacaattgagatatttattgcctactattttaaagatgttttatgtgttttcacctttggaatatattgttacatttccttgtacagataattttggtggctttgttaatgtagctagtaatttttatgactactaagtgaccagttttcggtgccttttattgtgggatgcatgattatgtatttattgtacggaagtcactgacgtgtgtatttttgtactttgctgaaagtaatggttgatcctgatgtacatgatgatgaaagacatctttcccaaagggcactgccttgagatcatccttctcaaataaaaagaatgcatttgaa

SEQ ID NO: 1150 - DNA, 705 bp, Homo sapiens
gtaaaaagtagcagcattcctaagttgtggggtgaagcatctgtttcataacacaggtctatcataattgggttctgtaaatgtaatggttctctaaacattttaatgcccaggcttgatattgtacacaatgcaagatgtctaaaatcttcatttagaattcaagggtattgcttgctatttcacattatatactttttaaatactattgctctttgtatatgaggcatttcactaaccttggatcattggatcttaaacatgataatatagaatatctgaacattggacttgttctttagagtatatggcctttagttcttgtggaactaaatacagtgattctaagatcaaaagtcttagtgtttggggtttttttttcctctttttggatatggggtgtttttttttgtttttttgttttttttttttaagcataatgctgtaaaaactgtccaagcttatgttttgctggtgattggtttaaaactgatttttatgtatccaaatgctagcataaattagattgactatcctggtgactgtagtagttaatgtaacacattttgtataaagtacagtttatatagtatttaaactaattcagatgaagttttatttcttgaaaacagttatttcctttttgtttattagcatgtgtataaacacaaatcacatgttcataaataaagttaacattctttt

SEQ ID NO: 1151 - DNA, 465 bp, Homo sapiens
ctggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgc

SEQ ID NO: 1152 - DNA, 616 bp, Homo sapiens
tcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaattaaaatattgtgtaaaatt

SEQ ID NO: 1153 - DNA, 447 bp, Homo sapiens
tgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagac

SEQ ID NO: 1154 - DNA, 484 bp, Homo sapiens
gcgggctccgcgccccaccgcccgccggcagctcctctcgctcgctctgcgtcccactccaaactttttttatttgtcttttaattggttgttattcctccgaatgaatgatctttcttcttccctaaaagcaaacacaaactcctttggttcggaagaggtctcggcggtgctttttggtttctctggagatttttttcacttcacagcaacgatcttttaaaaggcaccttttagcttcttttaccacatctcatttccttatttctcttccttcctgttttcttgtcttttttttaaccccaaattgaaggggattataaaaataaaagagtgaaacgcttgcggcttttttttttaattctctctcctttcaaactctgcgaacaccacctcaaaataatatacaagtgtgtgagaaagggggaagaaagcagccaacaacccaaacacccgctcagcacagctctaacaacacgctctg

SEQ ID NO: 1155 - DNA, 737 bp, Homo sapiens
gaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagacaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaaaaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagt

SEQ ID NO: 1156 - DNA, 423 bp, Homo sapiens
catgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactgagattacctacctcccagtagtgaaaataataaatttatcccttgaaata

SEQ ID NO: 1157 - DNA, 449 bp, Homo sapiens
ttgtctctggagatcccagtttctacatctgaaaaccatatgcattcctgctcaccaggaattatctcgctgaatgaagcaagagattcaggatgtgtaagagaatttatgaagcatttggattaccaagaaatgtgaagtataaagatcaagaatgattattacaaacactgatggtaaagaggtgtttcgaagtcgatgcaaaaaatgagttgcttatttcagtctctctttgatatatctgcctttttagtgctgactctatcatgtattcactatttgattttcagtgaatcacattttttaaagcttttaatctgtttcctcaaaaaatatattttttaaaaatatttactcaggattgttgtgagaataaaattgattcgattgatatttcaaaaaagaaatatatttttaaaaaataaagcaataccatttttggatatgct

SEQ ID NO: 1158 - DNA, 742 bp, Homo sapiens
tactaatgtaaaatagtaggctatatgttgggatgtgtatagctatgtcttcaagactaatactcagagaatcaaattgtagattgtacctatctgtgagcctatttctttagccagttttctgtctactgccaagaaacagaattctctgcctcatgcaaatgccctttcgtgtttacttttcgctctagatttttaaaaatgtgattgtgcccttgactgtaccaaagtgctgttgctataacagtgaacatttgtgaacagaggatgtttgtagtttcaaatgcagtacccatatgaccttgatcatattttagctatttaaaaattaagttggaggattttggcagaagtagtcacatgcatgattgctctgatagattggttggcgtgtgctgcagggggcttgtccttttaactctcccacaggatggatgtaggcagtgtcacattcattatgctgagagtgaaggttcatcactcctgtatcatggtagcaaatctcaacaggatagcttctaggatgttaagtgagcagttctccagcagaaatgatgtagaaggaaaaaattgaataattaaatttccttgtcttcacagtttgtattctacagagtacagtaatgtattacattccatttgcacccttccttagggaagaactttgtggttatctaccttctgagtggaatgttacagaaaatattttaaaatattggaataaacctatgattttattaaa

SEQ ID NO: 1159 - DNA, 410 bp, Homo sapiens
gtaatcttagaaagtgccaaggtcatgaaaatcaaagatagaccctggaactgttccaaactggaggggaccaaagaggcatgacaactaaacacaacacatgattctgaactggatctttttgcttgaaaggaagttacagggacagttggaaaagtttaaatggggcctacaatgccgtggtaatgatgtgtccgtgttaatttcctgattttcatggttgcctgttaagttacatcagaggatgttcttgtttgctggaaagtaaatcaatgtatttggcaggggataaggcatcaaatggtcaccttaatttcaaattattacagggaaaatgtttctctctgtacttaataacttttttgcaatttcttaaaatgaaagctctggagtaaaaacttcaaggatcc

SEQ ID NO: 1160 - DNA, 435 bp, Homo sapiens
ttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtctaa

SEQ ID NO: 1161 - DNA, 619 bp, Homo sapiens
ctgcccgcggataccttggactacggtgccttcccgcccccaccagtggacacttccgggtggcgcttggccatccgcttggtggaggtcgagtgggtgcaagggccctcaggacctcccacatgtacagttcccctgcctcttgccccggctagtttccctggagagaggcctagccaacaacgaagggacggattttaaaacagcgagaactgggtgccaagaaacacttcatagtccctgaacttttctggatgttgtgcgaacctgttgtatttttttttttcctgtattttggttctgagggatgagtaatgtgtttttagttcgttgagtttatccattcttcaatcccctaaagccttcagctgttctttcatatgtggccaacattttaagtacagtgtttgcttttataagtcggtgttacttggatgtcctataaaatacccactttttataaagatgatatttataacctaggaactcatgcctgtcttggctgcagtccctgtacatctaatatatactgatttgtttgcccccagagaatttttaaggtatctgcctatatcgtgatcttttgaaatggtaaataaatctggtgcattaaaaatta

SEQ ID NO: 1162 - DNA, 444 bp, Homo sapiens
gagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctccaactctatccttttcttatgacacttcagtcgtggggaatgaggtccccatgctgagtcctctgtggttttatcgtgtcctttgcccctttataatagattttttcccccaatttaaaacattaagaatggaactttctaaaatgttcatgtcctgagggccggtttaggccttttgtcttcggcacttaggatcctaatgacaataaattatttatgaagagtt

SEQ ID NO: 1163 - DNA, 479 bp, Homo sapiens
tcccctacatggtcaccggagcttccccacgcgaaagacctcatgcacgcgctcaggaagaccggaacggcgaatgctgagaaggtaacgggagccgacctgacttggaagaggaagcatcgactccacgagcctccccgactccttcggattagcctttgtggttgcacccgccgcggccacctgcaacgaatttagctcggcttaggccccgcagctcaggttccgcggccacgtcacgtgacgcgagggcggggacgcgctcgggagcgagcgtgggagcctggaagcctcggtgggtcccgaggctgcagcgaggccgggaccgtgccctctgctggcgggacctggcgttttccggcaccccgccccaaatcccggactcggtgttaagggaggtgcattgtcctgaaatgcttacaacagctgtcttcaataactcgtgcatagaatgcgcccagtaaatatgtgttgactgc

SEQ ID NO: 1164 - DNA, 602 bp, Homo sapiens
cttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcaggtgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatgccg

SEQ ID NO: 1165 - DNA, 750 bp, Homo sapiens
gacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaacgttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgcccgggtctaagaagtagagccccggggtagggtgggccatccactgtcaggccagtgtctcaagaaagcctgaccagctgagctgctgctttttttttgggggggggggggggaggggcgtcttgaggcttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcacc

SEQ ID NO: 1166 - DNA, 437 bp, Homo sapiens
acgacatcacgctggccaacaagcacctggccatcggcctggtgcacaacggccagtaccgcatccggacctttgatgccaacaccggcaaccacgatgtggcctcaggctccaccatcctggctctcaagcagggtgacgaagtttggctgcagatcttctactcagagcagaacgggctcttctatgacccttactggacagacagcctctttacgggcttcctaatctatgccgaccaggatgaccccaacgaggtatagacatgccacggcggtcctccaggcagggaacaagcttctggacttgggcttacagagcaagaccccacaactgtaggctgggggtggggggtcgagtgagcggttctagcctcaggctcacctcctctgcctctttttttccccttcattaaatccaaacctttttattcatcc

SEQ ID NO: 1167 - DNA, 502 bp, Homo sapiens
cagcctgtcactgtaaggcacaaacatgatcacgcaagatgcgatagtagatttaagccagttgtttttaagtttgtgtttaaggagaaactaacaatgaaaacggcctcgttgacggaggaaaagttggaatgcagcctctggtgctgtttgagcgatccctctccccggggcctggccgcgcgctgctgtgttctggaagggctcattgtacagtcaaggcggcaggaatcctcttcatctttctcaccaatatgttttgtggactctgacgagccaaatctgacatcagttctggaacatctagaagatactaagaagaaccattcagtgaagagagaagccaagctattttctcttttcctcatgaacattatatttagaaattaaatgttaagagataatatgatataatgttaagagataatatgatataaaagcatgattaatgactataatcttagaggaattaaagtctgggtattttaagtccttcaaatct

SEQ ID NO: 1168 - DNA, 711 bp, Homo sapiens
aacttccttacacttattcaagaatcactatggaaccaaatcctcactggcaccctgtcgtgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagagtacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatg

SEQ ID NO: 1169 - DNA, 373 bp, Homo sapiens
ctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 1170 - DNA, 409 bp, Homo sapiens
aaaatgaagatgcttttcctgatgaagcccaatcatgcagagtatgccagcaaataccttacagctcgaagcacctactacgtttgtaaggtggaacgtgggccaccaggaaccaggctggagaatgcttacagagcttttgtgcctctcctcaagaatccggagccttggctgcttgttgcactgcgcatacaatgtgatgccctggagaggagacgaattcagatgcttaaaatgaaagaagccaagaaggtcgttataattgaaccccctgcgagtgtcccgtccaagcaatcaggacgatcagacaaaaagaagtccactcgcaagtctccgacctttaggaacagaccagacttcaggaagaataaaggtcgccaactcaataaaaccaccaagcaaaagaagt

SEQ ID NO: 1171 - DNA, 876 bp, Homo sapiens
attctgagctgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtggggggaaggcaagggtttacagagtaacaacttacgtgttgttgtaaattacctcatctgtataccttgtattgggacactatttttcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatg

SEQ ID NO: 1172 - DNA, 473 bp, Homo sapiens
taaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccatt

SEQ ID NO: 1173 - DNA, 596 bp, Homo sapiens
aatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagaga

SEQ ID NO: 1174 - DNA, 558 bp, Homo sapiens
gaaggagccagtcgaagatcctgttcaagtgtacactgagccagcaggttcaccagaaagctattgagcgtttgctggaacacattatgcagggtgaatttcttctggaatgttgccaaggattttttatgcttctgtggcaggcatttcttgaacattgtcatttagccaagcaaagaagattttcttaaaggatagaaaatgtttaaaaatttttgtttgtttgaagataggttaaatggctatatgatctcaggataagacagagaaaatcacttatttctctaagtgatctgattaggttagtgatgttttgcctttaaacagattcatcattattcctaaagtattgctgtattaatactgtcttctagaaagtatccaccagtgcctacttttcttcgatatcattagctgtttttcgaaactgaatttgctcttcagagatttctcatatgtttgcgtataaggaactactggtaatagccaagaaaatttggaggtgcagagaacatgctgaaacagaatttttcactttcaattctagaactatgccat

SEQ ID NO: 1175 - DNA, 784 bp, Homo sapiens
caaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagatttttggagatttataattacattcaaagtatacttttttcttgaaaaaaattacagattttttgcaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgacgtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacattttt

SEQ ID NO: 1176 - DNA, 593 bp, Homo sapiens
gtatttttagtagagatggggttttaccatgttgcccaggccggtcttgaattcctgtcctcaggtgattcatttgcctcggcctcccaaagtgctaggattacaggcgtgagccactgcacccagcccaaatgagatgtttctaaatctaaagtttcttctgcttctgcatttctgtgaatctcatttgaaatttttcagggaagggattttatcatttgttcagagatgtctttatttttattaatacccataaaacgtttgtgtatttgcttcttcctctttctccttttgatcacattttagctacttatctagaggatctctggccaagtattcccttttattgtattgataacaattcttaatggctggcctctcttgtgtacaatgagccaatattcttttttgttctatatttttgtatcttcccctttcctgaacaaagcatatttagagtctcaaagaaatcctctccacaaagacatgttcctccctctggtgtgggtagacatagggtaagagtttggatgaaacttttgtaaattgtagtgttcttggcataaatatgaattaaatctttttttatattt

SEQ ID NO: 1177 - DNA, 630 bp, Homo sapiens
tgagcttttagcctcagtttcctcatctgtaaaatgagctctaatgactttgtgactctttggtgtggccctggagcctggggccacggtggagttcctggccggccttgccacttgacaactcctttaaggcttcccccttaacacgggatccctgtggtggtgtttgggagttgcctggaggcaactccaagcctggcccccagctgaagcatggcaatctggctgctctctacagggacccccaagcgctgtgggtggagggcaggggtcgggggggttgaccttcttgggtcttcacatggcctaggccagtcctccggtcagactggtgtcaggcaccgtggtgcaaaattcctcttctggcccctccagtacccagagaaactggctgggccattaactgctgcagcaccaagggtggtagaaagagctgtgaagagcccccaaaccagtaccaggacacctgggttctcctgtgacctggggcacagttcttgccctctaggccttgatttccccacctgcaagtggggatgccagccctgctctgcctccttcatgaggctctggaagactggccaaggttgtggaggagcttgtgaacttgattaaagtgtcgtaacatgg

SEQ ID NO: 1178 - DNA, 443 bp, Homo sapiens
ttatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtc

SEQ ID NO: 1179 - DNA, 551 bp, Homo sapiens
tgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgagctacgaccccttccgctttgacccagagaacagcaaggggaggtcacctctggcttttattcccttctccgcagggcccaggaactgcatcgggcaggcgttcgccatggcggagatgaaagtggtcctggcgttgatgctgctgcacttccggttcctgccagaccacactgagccccgcaggaagctggaactgatcatgcgcgccgagggcgggctttggctgcgggtggagcccctgaatgtaggcttgcagtgactttctgacccatccacctgtttttttgcagattgtcatgaataaaacggtgctgtcacctc

SEQ ID NO: 1180 - DNA, 451 bp, Homo sapiens
tctcttttcccaatgcggcggtgcactttcgctcttgggggctgcaccccagacatagctggcaccagagcagggtgctcaggtggtgggtgctcagggccctgccccaggccactgggccgttttgatgacctcgaaggtcacaggcagaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagt

SEQ ID NO: 1181 - DNA, 903 bp, Homo sapiens
tatgtacaaaacaccacaaagcttatgtaggtaagtgatacataggccctacctcaaggagcttactgtctgaacaggggagaggtgtggtgaaggatggacaaattatatgtatttgtaagagtatataatttatggtaaaacaatttcaagaaaggattaaaccatgtgttataatgtttcaaagaagggagagattataaaccactggggtaaaaggataggcttcttggaggaagtgacatttgagatatatcttggatgaccgatcagattcccatagaagaggtctgagaaaagggcattccatgtagaaggaatgacaagagcaaagacatagagagttaattagaaaatgcttgtcatttatttcataatcgggggaaattattttgttttataacacttttaaaaaatatttagctttgcagttcctgacccccttaatgcctgacccttccaagcaaccaaagaaccagcttaatcctattggttcattacaggtaagttgtacagttctttgcctactgatgaaatatataataagtttgtaatgtcagaggggctaacacaaggaattaatattttaaagacaagatagtgatatattttgttttccaacttacgatcattagattaacagagctaacttgaaattattttcctatttatgttctgggttttctttcatatacagtatttgcctttggcttatagaattctcatttaagatcaacaggccctcagtgcacatgggtaaagtgttttatactttaagaatagttcttgctactcttgtgacaaatctctttctacttctgttgagacagaagactttatagagagcctaaatcaaatcagtgaacctaactgaagaaaaggagtctatttgcttattctacc

SEQ ID NO: 1182 - DNA, 439 bp, Homo sapiens
acaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaaccc

SEQ ID NO: 1183 - DNA, 409 bp, Homo sapiens
gcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagtctaaattaaatgtatgtatgtttcattatattgctcttaagactactgaggtggcagtttaattcttaaaaacaataaaatggaagcataaatact

SEQ ID NO: 1184 - DNA, 432 bp, Homo sapiens
gctggaccacgtaggccccagatcacacctgggggtccagatgtaggggtcccgtgtgcacgcccaatcagaccgagcacttgtgacactaccccaacacctctcccagggctgaatgaggaacgcgccactggacacatgaggaagaggctgccctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatgg

SEQ ID NO: 1185 - DNA, 527 bp, Homo sapiens
caggaccccctcttactgcaaaacccagcctctactcaacagttctggtgatggggagcatttattccataacagtgtttttttgttcttttttttttttttccccagtgtctcttttaaagaaaacatactttattttggtctaaattgtgaaaatacccaaaacatttgatagaaattgaactctgtcaacagtgttatttatactaagatcaggacagttccttgagatcatactgttttattactaagtttggcctttgttttacaaatgtaatgttcatatttatttgaattttaagattggttaaatgttaatgaaaagcaatccaattgttaatttttagtagtgccttttctctgtatgccttaattttattttatattagtaattcaagttacccaccaaaatgaagattttttccaaaatcagtaggcttcacaagttcatttggccttagactgtgtattggtccttaaatgtttcttaatgcctgcctcctcctacccttttctacctccttttt

SEQ ID NO: 1186 - DNA, 1100 bp, Homo sapiens
ttgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaaatcacaagtttgtctaactcagtagaagatccgacaaagcatttgcagacaacttggcaagggtacagagaaatggatgtactgttttacagtatttggggagggtggtttgagcagcatttattgacaatttcattagtggggatgtttctattgaaaacacagagttaggaagtcataaaatgttcttgcaatataaggtaataataccaccggcgtttatcttatgttttcatgttctaagtgcatgcatctgagtaaaaggatctgggctgcagtccagtctgagagatgccagcaaaggcttcctaggccaattcagtccagtaaatccctcttcaatcttctctcccacacagacagcagtgatgagcatgcccgtgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatacg

SEQ ID NO: 1187 - DNA, 525 bp, Homo sapiens
caatgctagaagaacccttggaaaacatgctggcccagccctctagttttacaaataagggagtgcacagccctgagaggttacatggcctgcccaagatcacgcagtcaatggcagagtaaagagcatagcctaggcctccccactcctctagtaatgctctttcatcttctccaacctggctctaagccttgtccatcctgagccccatatctagcccaacctagtccctgaaaacaagaagtggcccttagaaatctctctccagtcccactatcagaggccaactgctgtcttccagtctccttcagcctgtgctcctctccctccctgactgacaggcagaaggtactgtgcctctggatatccccacagtgccctgagctgcatctcttgctgactgctttaatacatcacagtgacattgtgtgtgtctctgccaccagactattgctccttgatgctctgggtcacctgcatctagcatggcatatatctagtgctcaataaatgtgtattgtacag

SEQ ID NO: 1188 - DNA, 907 bp, Homo sapiens
tcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcataccgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaatttgagtttgtccttgttctaggagttactgggtagttgtaagtataatttttattaaatataatgtaaaataaaatgttaagatacttagttttgtttttcaaagtaaagctgtagtcagcgttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactg

SEQ ID NO: 1189 - DNA, 611 bp, Homo sapiens
tgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccattgatgtctga

SEQ ID NO: 1190 - DNA, 456 bp, Homo sapiens
tccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccgggtgcagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaacc

SEQ ID NO: 1191 - DNA, 660 bp, Homo sapiens
tatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaatttt

SEQ ID NO: 1192 - DNA, 489 bp, Homo sapiens
tccctcaccaccctagagacagcccacggtcctgagacaaggatgcgggccaggcttgttgcacgtaagcgcctcccgcagaaaccagtgaggccggagttccagaggaaatgatgtagggacagaggcagagggcctccaggaggcaccagccccagagtcttccctagaatcagactttaagcacaagcagggagggaaagcacttgagcagtgcccgtccctgcatacctggcctctgctggaacccatgcagggacaggacacttctttatcagcaatcctgttcctctcctgggcagcttcaacctgaacatcctccttcaccttgagctaaaatgggtttcttgtcacccttgcccatcaaacctggccttgccctcaggaaccacacaggacaagcctaatacttccttcttgtggcaacactttagcaattgagacctggctgtcaggtcctccaaataaacatttgtgactgtgatgttg

SEQ ID NO: 1193 - DNA, 465 bp, Homo sapiens
gaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgt

SEQ ID NO: 1194 - DNA, 443 bp, Homo sapiens
acccagcagggtacagagggcatttgtgggagcagttaggaaaccaggacgtccagcttctgcctgccagggagctcgctcatgttgtctctgaaatttgcataagagcaattacctcatattctaattttaaagatacaatttttaaagacatggaaggctctgagacctcctgaaggctattcctatgtgaggtattgtttacgggtggcctttcactatttccaaatcagcgatgaaaagaagactgagtctaaaataaatgaagcaacagacttcagcagcctgagagaattttgttcaattccagtctccttaaaaaaaaatcggtttttgctttcaatttaggaaaattgttttgggttgcattgttgaaagtaatgatttctagcagctacttatgtataatctcttaaccaattaaattctgaatctcttaaatc

SEQ ID NO: 1195 - DNA, 816 bp, Homo sapiens
aagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacaa

SEQ ID NO: 1196 - DNA, 734 bp, Homo sapiens
tttcttaaccaacaatgggtcatttagcaggacatttatttcagtcctaagttgtattatccctggtaatttgcatataccattattaaagtgtggcagtcttttgtaattattgtcttaatctagtgaaaaataatatatctgtatatctggagagaaggctgttctctggatgcagctgagcacttgcatgcactcgatgaacgggaataggactgcatgaggctgacctggatttgacaaccgcaccaggacaaggccgcgtgctgccctgaacagtggcccttgtgctaaatacgaatcctctctctcccacaggcatagcccgtcacctgcgtctggtttttgctcctcattttcttcaattttcactctatttatagttgagaaccttccatttccccctggttgaaatacattagttgctatggaaactgcgatccccccggtgtggatggagctgaatgacacctacaattgcagagcacggttggcgttgcccagggctgggaaatgggcgtcgtggctggagagggcactgaagggcacagatgagaataatgacagcacacagcacgaccgtcaggaaccgacgcagcaccactgggtcagaagttgtggaagaagccatgggtaacagaagccccccatgccctacaccacacagaggggcgggtcccatcagaggcctaacccctggagggctctcattttcaaaacataaaaaatggagc

SEQ ID NO: 1197 - DNA, 473 bp, Homo sapiens
ggaaaaagagtcatttaataccttaagggagagtaggaactttcagttacctaagactacagccaacccccagcccagaacaaaaacaagacaccttaatgtttgttcaaagacaaacccacagcgaacggctctcgcacccctgctctaactcctctttctgggggaggaaggagggaagggccaggtccgcggggaccctcactccctgctttctatcacacgggtcacaaggcagctctcagagcagaaggcacacacactgcagtggaagttgagaaaggaagtcactccaaggtacacactggcccaaagaccaggaaaccgtgccacggagctggaaggcaaggccgatgggacggtgcaaggaccacgcccacgatagcgcctgccgccccgaagggcctcgtgacacatcaggtcacatctccagtcaccttatttgtacacagttctctcctggaaaacctttc

SEQ ID NO: 1198 - DNA, 451 bp, Homo sapiens
atcacaaatgaaacaagattcagacttcatgaagagcactgcgctataataaaagaagaaatgagcacatacattcttttactgacagtcaaatggtgaaggtgggcagaatcattatgtgatgcaacatggcaaaagtatacagacagtgcatccagaggaaggcaccttgctgaatgactagaatggaagtaggagacattttgcaggcccccttcatcctgcagggagaaccagaaccacagcagctctatttgcctattcctctttaaattacaaagttaaaatttgggagtagtagaaaatcaattggttatcttatagagtctcctagaatatttcattggcattgagaaggtggaaaatgcaaattatatactttaaaatgtaatttttgcttttcacatatgcttaaagcctaaaacctcttaataaacttcttctgaaatat

SEQ ID NO: 1199 - DNA, 620 bp, Homo sapiens
aaaaagtgaaaataataccacatggagttgcctgtaggttaaattacatattttatgaaaatcacttagcacagctcctggcaaaaccgaataagtgctatctacgtcagcatttggcgtttgttgccctgggcataaaataccctaggacccctctttctatttcgcctggctcagaagttttgacgtggctactgaaatacaagacaaggcctgctacttactagtgctgcttttagtgaaagtgtgctaaaagtatttatagattttatagctttaataatataaaatgtcaagaacaggcagcaatttggcaagagaaattccagattgcattttacagcttctatgataaatgactgttacataagcaggaaacatacctcattgaaaatggcaactcttttggcatctatagcaaatataatgaaacatgctgtttaatatttcacttggcagaaattgtatttttaagtctttctctgcatataaatgtgctttaaactgtcgtatgttcaaagttcatttttaagtctcttgttcagaattttaaagatatttcttgtcaaactgatgttcccaataggttttcaaaacagtaaatgtaagagttttttgtt

SEQ ID NO: 1200 - DNA, 711 bp, Homo sapiens
ggagcccagggcttgtgagccgatggcagcaccaggagaggagtcaggccgtcgactgtgcaggagatgactttcccagctttgctgacttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttaaaaa

SEQ ID NO: 1201 - DNA, 495 bp, Homo sapiens
ttttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgac

SEQ ID NO: 1202 - DNA, 726 bp, Homo sapiens
atacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatg

SEQ ID NO: 1203 - DNA, 501 bp, Homo sapiens
cacaggcccagaatgaaggggcatctggaccaatgacctagattcaacacagggcttggagctggtggtacaggctggttttggcccaatgtgtgttggaggctggaagcccctgaagacctaaactgcctggatgagcttattagggtgaattaatgagtctgtaatttgggaaccttaatgtgagacaccacttaaggagaggaacttggcccagcaagtgatcactctagaagtggacagctatgcactagactgcaccagaatctgttcaacagcgacaccttgtggtaaaaactgtagacgccccatcaggctggatgggaaactagaaacagactgtctcatctttggacagatatccctcaaatctcccaatctactccagggaaaagacacttcaagtgagagatattggacttcttgaaaatctaggcctatggaaaattaaagtgttaaatggaaaaattaaagagctatgagtctatttgtaatgatgaa

SEQ ID NO: 1204 - DNA, 462 bp, Homo sapiens
ccaggaaccagttcctgtgcccaaaggtacgaatgtgtcttttcgaattcccttgataaagaagcctcagacaaggaagaaaatagaaatgaaattggacacataaataggacacccagcaaaggccagaagagaagcccttctaggagaagggacatctgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttcaaacatg

SEQ ID NO: 1205 - DNA, 600 bp, Homo sapiens
tgaaaacctgatatgattctgcagcatgaggtctacggtgaccatttgggcaaagctccagtggcaatcatttattgtgttttgcatttcctgggatttattgaaataagaattcactgtgattatgtagtcttctggctagtatcaggcagctctgcttttaatttggttaattttattttctctgaagagggagaagaggtacaatttaatcttggcctccacaagcatattaaagctcacgtgttaatcagtgcattcttatgctcctacattaaatgccttgggtaaatggataaatggacatgtgcccagctttaattttttttgcaacagaaagatcagacttccgtatggcatcgttggatttcagaggctttctggtgtatctgtaaatctgaatgttgccttctgccagtctgtataaccaggtgattcatgctgcaaatgaaatcaggaagcagtaaagtgttaaagcaagagtattgtccaattcacttgtcttcctgatccttgtactttatttcacgtgtcggtgtttacattacatacttatatttcctgtgaaagaaagagttaaataaattgtagcagtttgaa

SEQ ID NO: 1206 - DNA, 395 bp, Homo sapiens
atcatggatcctggggaaaggttgcagacacaggaagggttgtctcctctctgtggagccctgctgcttaccacacagcaccttctgcagagactagctctgagggtggcaggggaccccacagccatggccactccctctctgcacctgtccgtgcctgctgtggaagcctggactgggggaggagattgctaccctgtgagcctgagggagccacgtccagctgtgacctctacctggggctttacagagagttgtttatgggtaacagacaccttgtttcagagggaatgggcatgagctggcaagtgaagcacccccacagcttatcaggaactttttctcatttttaaaccatcatgtcttcatttcacattggaataaagtgaggtttt

SEQ ID NO: 1207 - DNA, 694 bp, Homo sapiens
cttagttccaatgtaattatctaggttgagctaaaagtttcttttcatctttcaggtttcctcttcatgcctctactcctatgcagtttgacctctcagtgtgcagctggtgatagatggaaacccttgttcataagctttgtggcactgtcggcaggatgaggggacttctggatcctcactggtcactgtggcagagtggttggtgttgtctgctccctagacaggaacccactgaagaatctgacattttttgatatgctggcattcattgttacagcccatcatcccagccatcaatccaggacatggggtccgtgcccacggtgggaaggaggaggaggaagctggctttgttctgacgttgggcttcttctgctccaccagtactttctgtgggggaaataggtaaagaaatggctgttcagatgagaagatgtgtcagtaaacttttgctacagtgatgctgcaaaacaaatcactggtgactttcagtggcacacagcaataaacatttatttagctcagggattgacaatctttttttttttttaaagggccaaatagtaaatattttaggtgtttcaggccatacagtctctgaactctgaacttgtagcacaacagtagccttagatgctatgcaaatggaggagcatgactgtgttccaataaaactttatttatggacact

SEQ ID NO: 1208 - DNA, 461 bp, Homo sapiens
aaatagttgctgtataatttattttcataaactataaaaaaatactaaatggttaaaatagacttgcaggccaatcttaaatggggtgggaggggtctgagggtgggatggggaaagggaaagaggttttgatataaacaaaacaaatgcactttgggtgtgttttggtatttttctggggatagagggggtggggttagggatgtccctgtagattagttccagaatggggtgtctgtatatactgtattaataggcatgtttgactctcgtaaagggacgttagtagctgctgcaggtcctgtttggaaaccccatgtacaattcccagttttttgtaagtgtcagtgcgagagacatttgactcttgtgtttgtatctcctttttatgattgctgtacctacccatgtctttttggggaggggtgaaaagagatttgaaataaaaatgtttagaaatt

SEQ ID NO: 1209 - DNA, 422 bp, Homo sapiens
tttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatatacatccccatgtttaactgacacactgggggctcagttgtgtgctgtaatgtcttattaaagaagatattaaaa

SEQ ID NO: 1210 - DNA, 614 bp, Homo sapiens
gctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagttttttttttttttctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcact

SEQ ID NO: 1211 - DNA, 505 bp, Homo sapiens
ctactctttctagtcaattaaaattgataatgcagcatgattcataaactaaccagctgtgcctccttttattttgaggaccctgtagtcactataataaatttctaagccaaatttttcaaacaagatagttcttatagaaggagaaataataaatatgtgtgtgttgatgcatgcacacagaatgacctgtgaaaggaaacttaaattttgccggtaaaacaaacatatctctacagactgtgattatacttcataagcatttaaatacagttttatttatttccttaaatatattacttgggtaattaattttagatttgattgcaaagagcactgtatagcagttgggaccagctcttggcttggcttggcttggcttattgttaagagtttattggatcaagactaacaaataactttgtgatgaaaattcttcaaaaatatagctactcttttcaagtataccatttaaaatatttcatcaggcagagccctgaccagg

SEQ ID NO: 1212 - DNA, 485 bp, Homo sapiens
tgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttg

SEQ ID NO: 1213 - DNA, 596 bp, Homo sapiens
agcattgtttataatagtaaacaaatggtcccaatgtcaatttccatcagtaaggactctatttgctgtgtattcaaatcttttataacaggaatgcgtgtattttgtgtaagaaagaatagtaggctatggaggagggggtgatagcagcagagagaagcataaaagacctctttggcaggaaggatggcttccagaccagctaagtggagcaagcatgttttgaaggacactggctctaatagggagttagcatggggtgggtcacagaacgtatttgatcaggcaaagaggactcttgccatccaagcctgttccctcagataaatggggataattcatatgtcataagccaaataaatgagggaatgaaacatacgtaactaataataaaaagtgttaaaatttattgggcatttaactgagacaatctggttccagagcctgctctcaatcccaatgatgtgctaccttcacatcctagttacgccactgactagctttgtgactttggacaagttatttaacatcccaggatctgttttttacctgtgtaaaaatgcatatatagtacctttttcacaagcctcaaaacg

SEQ ID NO: 1214 - DNA, 1138 bp, Homo sapiens
gtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaacc

SEQ ID NO: 1215 - DNA, 611 bp, Homo sapiens
gggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattag

SEQ ID NO: 1216 - DNA, 447 bp, Homo sapiens
taaaatggcggcttcaaggcgtttcacgggtgtcccggacaggcgtggaggtggggcgcaggcgaggatgaagcttgagttggccaggagtcggaaaacgattgcaggcgggaccgcgtccgtcggggctgaggaaacttagcgtggcagaccctaaactgggataactttagggatatggccttcttttcccagttgcctcaaacttagagcagcgtcgtctttagccgaagattcattttcccagcattttccttctccaggcggagtagttggagacagagggcaagccagaaactgaccttcccatctcctcattcccttccatcaagaacttttcatcgttctttccccaccctggtttgtaaatggtatttggcttcataaaaacgtttgtccacaggtgccctgctccatcagttcgctccagcaatataggaagttacc

SEQ ID NO: 1217 - DNA, 612 bp, Homo sapiens
cagatttatatcttctgggcggcttctttaaatccagcccttcacccgccccctagagaagcagtgaaaccccttggctagtccagctggaagagctagaccgcagagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacat

SEQ ID NO: 1218 - DNA, 637 bp, Homo sapiens
aaggttgtcaggaagcaattttaaatttctaatatgtaaacatcggggctttggcatattttgaaccattttgatgataggaatggaggtggtaggagccaccctgattaagttcttgttgagaataaactggtgcaccagacatttacataggctgaatcaatgttgatggcagccgtgtttttaatccatgggcctaaaacagtgtccctcatacctgtctcttgctgaggcccctgtcgcaggtgagccatgtctgacttccgagccttccatcgactgctcagtccacgtcttcagccctatttcccaagcttacctagtgagtcctccttgactcaggctggttcctccattgtttctgccacctgcaggccattggtgctccttgaataccctgtggtgtcatcgctgactcgtgcctccagggctttcccgctctgacggctctgtgtttcctattgcttcatatagcttgcttctgaattagcatgcgatatgtgacactcatatgttatgtatcttggtttagtttttacagaaagatgaaagactcttaaaagggatcttggagttgttcttgtacatcttttatatctcctaagcctttgatgggcacttgttccaaatgggaaag

SEQ ID NO: 1219 - DNA, 643 bp, Homo sapiens
gaactgataaggatgagaatggtggtgccagcttctgagggcctgcttggctcctgggggcaaagcctctgcccgaaggcaataacaacagcagcagaagcaatcccggggagctgccaggggtgtctgtctctgttctccttggcgtttccttcatggccgtgaatcccagctcacccatggacagaagacctccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtgggggctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccat

SEQ ID NO: 1220 - DNA, 602 bp, Homo sapiens
caggaggtatggaggatagttagatttcctgttgtggattttcaggcatcaccgagactcctgtcaagcctgcagtcatttactagttttcatatcgactgcaggttctctttgagcagttcagtttttggtgcttaagggcaggtgcacaacggggtctggggttagaccaggcggtggatagtcttgatgctaggcagatgcagttatccctaccaggcccagagggtgactctgtttaacttcaccacgcacgcagattcaggattctctgatttccccaactttcctttattcttcttttagtgggagaaggggcaaaagtagaaacctaaaaaatcctgggaaaaggagccttttctgaggaaacttcagcagatgaaatatttaagacttgaactgggatctctagggggaacgttggaacatctattgattgatgtgtcaaagtccggaatttcactgtaattagtgaacgattataacttgtaactttgtctgttatgtaagaaattacattttggtctcttagatccaagagttcttgtctgttacgatttgtaactgcttgttaaaattaaacatttacatatttcattctc

SEQ ID NO: 1221 - DNA, 529 bp, Homo sapiens
ctgtctttcaccacctcaggagcaacagcagttaggtgttcagatgtgaagtgtgaagagcaaaagtttcctctactgaagacagacagaaactcaaatgaaagctaaagatgctggctgtccccccaatagtgacacctagggtaacctggagaaatggtccacagagaatagtccatgatctgtacaaacatccagagagctgctttctcccatggcctcccacaggtctgactgccagagagtagaagcaagaggggtgaaaatagaggagtacctgctgtgctgtcatttcaggtctgctctggagaagaacatgggctaagaattatcttttatgatctgaaaaagctgtctgaagttccttccaagcttatcagcctcctaacctgagctttaacaaaacccggtatggtagagtcctagtgtgccaatccagctttccttacctggctgtgtgagtcacttaatatctttggacttaagattccttacctaaaaatgagggttgagacgtaggattcagttt

SEQ ID NO: 1222 - DNA, 601 bp, Homo sapiens
cacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcactttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagac

SEQ ID NO: 1223 - DNA, 542 bp, Homo sapiens
cccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagatcacctctgcagcctgcacagccgggcctttggactcctggatgctagagtgacctgggcgctgaggagggcccccgagccagtaccaggaaaggatagactcctgcttgcagcattcccagcagaggcatcgcctgtggacaccgcgtctgtgtctgtatatggcagagctcccagatatatgcacaagggagtgaaaaaatgtgtttgcaccccagtctctaaaaattcaacagcctggttacttctgggtggtatatcgtaggtggctttaatacgtgttatttgctcatctgtatttcttactctttgcacaattaaaccacgttccttttacttatgtacatttttaataaaagaaagttgtt

SEQ ID NO: 1224 - DNA, 477 bp, Homo sapiens
actagtggaaaatcagaggcaaaaaaatgaattttgatgagaagacccctgggccgtgttcagtggtctctcaggacggagggcatcatcctgcctcttaggttggctgaggcctgcgtgtggtgtccttagaaatgggcttcgaatagaagctccagccctgtgggggcgtctcctgggtagggagtggcgtcccgttttcccttaggagggtgtttctgcattgaacccctgagtgggacggcgttcccggcaaagctgggagggaggcgagcgtggggcaagacccttgtcttcgaggccggggccctcttgtatggggcggttttatgttgcagtcctctgatactttctgagttcaaagaggtaaatgtataaatttcagtcccttctgaacacagatatcatcagaaaattaccattccctagcaggatgttttcgtgtttgtattcgtatatgccagttcatttcctttg

SEQ ID NO: 1225 - DNA, 573 bp, Homo sapiens
cagaaacacagtgtgggtccaacaatctgttttaacaagtcctctggttcgctccaggctccagggtgggacagtcactggtgcttctgctggctgggacaacagggccccactgtggaacttgaagcccgtgaccccctcctaacggctcctctcagttcccgtggtcccaaaagccctctgtcccgtgcagggctgccccacagtggccttccacatcctcctgatagcagaggcccccgccacccccagggccacctctgcagctgtgccgcagcttctctgcccaggcacctgcactgacacggagcaccctgtaggttgtctgcttgaggcctttacctaaatgcttgccgcagctgtttctaaactacaaaagcacacaatcatgaaatgaggcagaggtgggctgagtgccacaatggatgccaagaggaagagagatggacatggcgctgggaggctctgggcaccactggaggggggcgctgagttcccgggctgccccggctgggagaggagtcgagtcttaatctcctttaaggaaacataataaataaactactttgccac

SEQ ID NO: 1226 - DNA, 515 bp, Homo sapiens
gctactgctttcaatttaaagtaggaacaaaaagtgctaatttcttttttaggaatgtctaaatcagattgtatgtttggatcgccctcacctgtcccattgaaaccaactggtttatttgttcaggtaaacctagctcaaacggagaaggaggcgtgtctgtcatctgttcactcaggagctgctccctgagtgctctcagctctgcaccatgtccttgcgctgtgctggcagtgtgggccctccttcctctggctgacctgcagcactcctgtctgtcctgcgcgggtgtggtgcgtggtgaggcttactgggcaccggatggcggggccttgtttcagaactcctgcccatggtcttgcttttcagttaacttgcaaaattctgccacccacatgccttatttcagctctccttggatatggtttcggttttaaggctgtttcagatgctcttcctttcgattttgtaaaccagtctatttcattttttaggcagtgcttttacatgaagac

SEQ ID NO: 1227 - DNA, 1247 bp, Homo sapiens
aaggcggttttgagctgggcaggacttgagcccaaagagcttgcttacttgctgggaggcagggcgagtagacgccgacttcaggacgacttgggcctgcagaggtcgccaggaggcccaagctggcggcggaggagcccaccgaccggagaccgtttggggcctggagacgccatcggagggcaggagctgatcctggagaggccaccgtgagcctgacctgggcctggggagcttggcttgaggaagctgtgggccgaccaaggcgccaggagatgggcaggcgctgagtccaaagaggttgttgggaggcagcagtcgggcctggagacgcagccgggaggaagagctgggcccggagaggacgccgggaggccgcatgtgggtctggagaggccgacttgaggaggccggcctctggcctccctcatggcggcctctgcaggccagctgttcctcctggctgcatctctcggcccagctcctgcctcccagcaggcaagctcttttggctcagctccctccagcgtttgtagaccccgaagtttctgcagccaagctcttcaggcccacatcctgcctcccggtggcctgtacagtcccagctctggcagcagaagagcgtcagcaggccccgctgttgcctcccaggggcgtctccaggcccaggtctcgccccaccaacgcctcccgcggccaagtccctgcctgctcccggcagcctgcgtacggccctgctcttccctcacggtggcctgttgaggcagggctcacgctgacctctctcggcgtgggaggggccggtgtgaggcaaggctcacgctgacctctctcggcgtgggaggggccggtgtgaggcaagggctcacgctgacctctctcggcgtgagaggggccggtgtgaggcaagggctcacgctgacctctctctgcgtgggaggggccggtgtgagccaaggggtcagtgtgggaggggccggtgtgaggcaaggcgtcacgccgacctctctcagcgtgggaggagccagtgtgaggcagggactcacgcctctgcgcagggtccagcggcatgagttgggcatcaacaggccaccgtgagggaggaactgggccgcacgcgggctgccgggaggccgccgtgggggcgagagcctggcctggagaggcccctgggaggcaagagcgggacctgcagaggctgttctaccgccagagctggcctgtacaggccaccgagaggcagtagg

SEQ ID NO: 1228 - DNA, 458 bp, Homo sapiens
agagcaaacagaagtaaggatggactggatattaccatcatccaccatcctggctaccagatggaaccttctcttcttccttctcctcttccctccagctcttgagcctaccctcctctcacatctcctcctgcccaagatgtaaggaagcattgtaaggatttcttcccatcgtacccttccccacacataccaccttggcttcttctatatcccaccccgatgctctcccaggtgggtgtgagagagacctcattctctgcaggctccagcgtggccacagctaaggcccatccatttcccaaagtgaggaaagtgtctgggcttcttctggggttccaccctgacaagtagggtcacagaggctggtgcacagtttctgcctcattcctctccatgatgccccctgctctgggcttctctcctgttttccccaataaatatgtgcctcatgtaat

SEQ ID NO: 1229 - DNA, 419 bp, Homo sapiens
ctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatct

SEQ ID NO: 1230 - DNA, 724 bp, Homo sapiens
tggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattattta

SEQ ID NO: 1231 - DNA, 584 bp, Homo sapiens
ggaactgagtgaaagcaaggccaagtatgtccacccatggggacaaacgtcccagcacaaaggggtctcaggcctgcaaggcccaagtggacgctcggacaagggcaggaaggtatttgctgattctccttctccatgtgacgtgtctctcaacccacaccagctaggggagcctcccgcagcttcagttcccctttgacgcccacacagtgttatgcaagcaccgagcccagagtcccgctgggccgtggtgtcctaattgtcttggtgacaaagagcaattttattttaaagcaactgaatcctttccccctgttttgtgtgccagtattttactgtcttcttaattgttttaagcaatgtttactttggatttctggatgttatataaaagccacgaaaaccctggccatgctgtttgtcaggcccacctggctgagtgcaggaagcaagcgcttttcaggagctcactgcaacaccgggcaaacacttcttccgccagggatgcggttaggacaatgccacgtggcgtcacagtatgctgttatttattccaataaagacctcgtgagcatgggcctgtc

SEQ ID NO: 1232 - DNA, 745 bp, Homo sapiens
ccacctgaaatgttaactcggtcccttcctgtctctagttcatcagcacctgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagc

SEQ ID NO: 1233 - DNA, 817 bp, Homo sapiens
cttcatatactatttattaagttattaatatgaacagatatgcaacattacagatgtctttcaaagcctgtaataaaatatagtccactatccagcccaggagaaagacaacaaacagtatcattcttatagtaagtgtagcatacgtactcacaatagttcccttatttggacatcaaagggaacaatcagtcaagattctttacctccattagaatttaactttcttggattatagctgttttagagtcaaaagtccaacttagattatccacagagatgtgtagcatcacatgttggagaggaaggagctactgtcacctccgtggcagccctttctactgtcttgcagtccttctatatcgaagcccatcttgccttttaggccagtagtggtcaaatttgggtatggggagaaggcaggtgggtcacagggaggttttgattaatttacaaagattgtgtttcaaagctctaaaaacccatttggtggtggcagtggcagtgaagagtacactatatttcgccaagggggtcttctcatctcttgagtcttggctttctcatatcctttaaaattgctgcagttctcagtgggaaagtggaggtggcaaactctaacagcgattggtatggggccatctgcagaatgaactggactggctactatggcttttataacctgctttcctttctttagtctagacaagcttatttcttcatctttccacctacgtcctgctagttctaacataagatttaaaaggactatggaagataaaacttctcactttctagctgaatgatgaaaaacagc

SEQ ID NO: 1234 - DNA, 861 bp, Homo sapiens
ccccctgttccaggaagctcatcctcacctgtgtaggccctgtagtacccacggtcagagacgccacccaccgctagccgttgttcctgtgcaaagtagtgtgctatgaccacccaggtgccgcctctgggccaaggacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacagagcggggctgccctgcctgaggtcccgaggagctttgtgctttggtgtccacccctgttgttactcatgactcagtttccttgacctggtagggtgttccctgctgtgttttccagtgtcctgtgactgtcctgtgcgggccatagggcagggcctgccccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtcttgccaggaaccccaggaggagggggcccgggacctgtgtgggacctgtgtcctgtggtggccgtttgcagtttctctctgtgttgtgattcccttctcttcaacggtttcagtacgtgtttctcttcaataaacttcattcagtgttcc

SEQ ID NO: 1235 - DNA, 612 bp, Homo sapiens
gtttccgggatgtaataagaatgccactctgggctttggaaggtgcaccgtatgcacacccatactatagggcaggggttagcatttcagacccctgttcctcccttgacaagcaagtgcttttctccagggaagacgttcaggttcattcatagatccattggtgccgtgggcagctcagtaacaatagctctgctgcctaccagctgctggtggaggtgttgagaatacctaatgaggaagtcagggcccctgcgtgcttcagcagagctggatgcctggcatggcaatcaatggacacaaacctttggataatttccgtccttggcggtgtgttctatagcataggtatgaagtgggtgctctgggagctcagaagaggggcttttctcttaacttatgggtggccagggaaggcttcctggagctcaaatgactgagtggagtcttcaacattaaaaaaaaaaaaaaaaaaaaaaagtgcttccctcccacccccagttaaaaaggtaatacacctcattgaaataatttaaactttacagaaatgtgttcctttaaagttcagagagtaaagaggaagtaataaagctgaaatagtagaatttctaa

SEQ ID NO: 1236 - DNA, 590 bp, Homo sapiens
gcagtattaagcagtggttaatgtcttagaagtcagacttctttttcaaggtcttcagaaccacacttgatttctgttttgttgcagctgtaattgacacacactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaacctgaaattcattgttaaaatc

SEQ ID NO: 1237 - DNA, 1303 bp, Homo sapiens
ctcaaagcagaggcaaggagcaatgtttacagtcaacttttaatacttactttttggaaatctcttcaaatatactggactttaataacctttgctgcttaaattcttccaagtaattaaagtctcctttaagaatcacttgctggtataaaatttcagcccaatctggaacaaaatcgtagcctcagccacaatagaagcctggtagaaccgaggtagggccagaatacagtccatcagcttgtggcggcccaagttgatgagcattgtgttctggccagtgttcagaaagtgaatctgcagagttatcaacttggtgagccgctgacagtgctgggcctgtcgcacacaggagtccttggcataactctctgctgcatccaacatcagagtcagggccttcagcagcagttgtttcagctggtgcccatccttgaggctgtcctcccagggctgagactcaatcaatttcagttggatgcgggcagctgcctcgtggttctcgccaatctcccggcacatgctgaagcacagggcaatcatattgtgcttttcactgtctccaggacggcagcgtttgatgtagtccagcagggctgttttcagggtaccactctgcccagaataaaaggtaaaaagcataggtgtcagtcagggactgcaaggcagacaggactagctgagtcaccttgttctgcattccttaaaaactcccaagaagaagcaggagcaaaaatgagaataaatacaagttttatgctgtcccaagtatgaggaaacaggcatgtgtgctttcctgttggaagtgtgaaaggcaaaactttttctaaagggagaaaccttaaaaatacacccgcataagctgatctaacaattccatttctaggaatctgtccctaaagagataagcagagaaaagtgctaagatgaatgtaacagggatatttaatagcaaacaatgagaaacaatccagatgtccaaaataaggggaagagaataccatgtagccattaaaacttatgtaggaggatgatttgttgatttgggaaatagtcatgatatactttgttaagtgagaaaagcaggatatttcatctcttcactgtataagttttattaaaataattatatatagatgttttcaggtacatgtgcaaagaaggcctataccaaattgttagtgactgtctccagatggatagacactgagggctttttctgtgttgttctgttttccaagtgtcttacctggaatatgcattacttttgtaatcaggaaaaagttattaaaatatttaaatg

SEQ ID NO: 1238 - DNA, 937 bp, Homo sapiens
gacagggaacagaaccttcgccccccgcctgagcagctggtagactagatatcttccaaacattatctcatttacttccctggagttacaaataggtagatttcatgtccgttgaggggtgagaaagctgaaactttgagacttaagaatcctggccgaggtcagcctcctccgaagcttcatctcttgccaccactttctggtgcacacctaggacagatttcaatccctgagatcccaggatgaaacctatgtttgccaaataccagctactgtgccagaagagatcatggaaccaggtgtggaaagctgcttgagaagaggagccaaaacatcatagttgaaccgtcctggaatagaaactcgccctgaattctttcttgtgtgaaatccaagagccctctcttggggttggatcgggaccctgttcctgtaacaagtccacaatgccagagaattaaagagaaccacaaagctgaacctcaaaaagttagcctggcgaggggaggatgatgagatttcccctgttgtcacataaacaaggaagtaaagggggccccttgtgctctcagaactccaagcatgaaacgatagcaaagggaaaaacagctaagtgtttcctggctgaattttattttgctttcagtttctgccatttcagttcctgttatcgtgctttgaggtgcactgaactgcagcaaacccaggggatccaaggctacgttgaaaagcctttgaccacagtgcagggagcagaagacattaatgacgtgatgtcgacacagcccgcactcaggatcctccaggaaaagaacacagagataaccccggatcgatggtactttttgaaaatgctttattgcaaaagagtggctagggttttacaagggctatgaagaaacatattaaggttaataaagctttttattgagtgttt

SEQ ID NO: 1239 - DNA, 471 bp, Homo sapiens
gcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctg

SEQ ID NO: 1240 - DNA, 426 bp, Homo sapiens
tttctgtcttgttatcacatttccttggaggagagcccagccttggtggagagccctgctctggctttgtccctcggcatgagatggcaaaggatggtgctgctgggagaccctcacgtctgcacactgggggctgcttgccttctccattcctccttcaagtatctgagcagctcctgtgtgccagctgctggtctacaagatggatcggtccttggagatcatgctgtagcagaggaggcaggctgtagcccacacgccacaaccagccccctgcctgttcacacaaataaagttttattggaatacagccacacccatttcagtgcatattgtctgtggctgctttcctgctacaatagagagttgaatagttgggacagagacctatggcctgcaaagctgaactatttaccatctggctct

SEQ ID NO: 1241 - DNA, 580 bp, Homo sapiens
ggtggtctctcatccttgtgtgctgctctgctaagagatgtccaaggcggagccggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaaccccccggcctctgccctggcatggtctccgcatgggctgaggtgtagctgattggctgccacatttcggccatgctggctggcgtgcccatgttgcagatattttcccgagttccccagaatggatggtattgaatctcagccacatgcaacactgtgtccagcattctttgcaataaatacttttt

SEQ ID NO: 1242 - DNA, 448 bp, Homo sapiens
tgtgaaggtggtatttgagatgaagtagttggtcagagtccctgtttgacacatggagaccaccttgacagcaaaggccctaagggggagcggtgcaaagcaaggtgggctggtgagtgagaggagagggatggcatagagctgggtgggggcacaggagcccgtggggaaggtgttcgcctctgaatgaagtggggttgtatcagataccacgggtgaagcatcgggaagaggatcctgcctgtaaaccctgctcaaggactgcaccatcatcatgcccagtgtgtgcgtgtattaggtttgtatgaatataatgttgccaattgtatctgtttttatgaaatgtttgctatgtgccaatgattattcgatccatggggagaccatagaagaatgatccaaggagttgggaggggaatcaaataataaatcagcgattctgcaatat

SEQ ID NO: 1243 - DNA, 451 bp, Homo sapiens
gctgggctgttttgggacctttacaaaatggaacttttctgcctgacctaattgccaggatagccgactgagccaagatagttttgtgttcaccaagcaactgtggaccaaccttagcttcaggaaaacagtggtaaaaaaagatcgatgaggaacactgccaaagaaataccctttcttccccgactgaaagatggctttgtccgttgagttgaaaactattaagtcctgccttcctcacttttcatcacgtggcttctgtttttgaattcctttttgttttcagtgatcccaccaccagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactgg

SEQ ID NO: 1244 - DNA, 449 bp, Homo sapiens
ggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagc

SEQ ID NO: 1245 - DNA, 706 bp, Homo sapiens
gaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaatcactcctaagggtgtccttctaatttcaaaatatcaactcctaagaggtcagcagaatttggagatttgggtccttataagaatagctggtgctcttttcttgttcatgtctcaaaacaaagctgttgagagaactgctgcgatgaatcaaaccagaggagtttgtcatgctccccacagagagcccaggacatttgcctgatgtatggtgctgagctccaccttcagaggaactctctcttttttttttttttaaataactattattagcttgacaagaaaaaaaaagtgcccaacagttttagtgttaatcttggtgctctatggtgcattagcagagatatgaacaattaaatgaagacaaagaaaataaaaataaagtctgattaacttttgctcattttgtctttgaggctcttcaaaattgctttgaatgctatggtttgcagaaaaagggtgagcatgatggctgtcctatatgtatgtaatgattttaatatgaatccttgtgtctggactctt

SEQ ID NO: 1246 - DNA, 510 bp, Homo sapiens
aggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatgaattgttgataggaacattagcagttaatttttacctgatactgagtttactgtaaaataggaaatgcataggaaggaatacctcctaaataatatgccttatagaatgatgaaatcttaccatagttcatactgaaaatgttgtttatttaaaagtattgtggagtgttgaaaataaagatacacaataagtattttctgaagagaaaattaatgaaggtatttaatgatataggaaataagtgacaagttaaagtccattttgtttcaataaaggagttgtgcaaactc

SEQ ID NO: 1247 - DNA, 475 bp, Homo sapiens
ttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagctt

SEQ ID NO: 1248 - DNA, 486 bp, Homo sapiens
gggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgcttttcgtttcactgggatccgggttcagagtgacgtttttcctcacaagcagaaggtaacaaatttcatgctctccccaaattctgtctgattttgccttgtggtgatagattgtcatgaacacaatgtcctctggagaaatctattgacagaaattggtgcagtgttaacaacgctaatgtaaaacacagaatttacagaaaaatagagaaaataaacacatttgttttcctc

SEQ ID NO: 1249 - DNA, 437 bp, Homo sapiens
tgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttggtcc

SEQ ID NO: 1250 - DNA, 581 bp, Homo sapiens
atacctgcataaaagtatttatgtatagatgtacttaccttacacagtaagtacctaaaatttgtaaattgaatacttttgaatgtaagcagttgaagtaaaacctgtagtgagttcttcagtcagtcaacactaaacctgttttgtaaatttgatgctagtattacactggactttctcaaaatgaagtacacctatatatgcatatagtatatgagcatgcgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctcctccctcaataaatcagttaacttaaaaaatatattgtgaccatttttataaaatacatgttcataaaacagatcaacatatttagcttatacagaaataaaattaagtcaatccactcacaaagaatttctattttgtaaaaatgtagcttgtatttcagtataataaaatctgatgtaag

SEQ ID NO: 1251 - DNA, 679 bp, Homo sapiens
tcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctc

SEQ ID NO: 1252 - DNA, 454 bp, Homo sapiens
cggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgt

SEQ ID NO: 1253 - DNA, 571 bp, Homo sapiens
gacatataacaccacctgctgcaacaaggacaactgcaacagcgcaggaccccggcccactccagccctgggccttgtcttccttacctccttggctggccttggctactggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccgtccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaatccaggctcccatatgtaccccatcccccatactcacctctttccattttgagtaataaatgtctgagtctg

SEQ ID NO: 1254 - DNA, 773 bp, Homo sapiens
cagcctgttcctgtgacacccaaagggtcacaattagtggccgaaagtttcttccgtaccccaggtggacccaccaagccaaccagctcatcctgcatggattttgagggtgctagtaaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatatatacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaagtatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttct

SEQ ID NO: 1255 - DNA, 434 bp, Homo sapiens
agcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgcttt

SEQ ID NO: 1256 - DNA, 630 bp, Homo sapiens
ctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatgatttgc

SEQ ID NO: 1257 - DNA, 483 bp, Homo sapiens
gccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaactt

SEQ ID NO: 1258 - DNA, 859 bp, Homo sapiens
gcggatgtccccggggcacagcgagcggttcctggtgacggcccagagccccgggaccccctggactgttgggcctgcgctgttcttgtaacagcccagaatctgctggtggctgccttcaatcttctcctgctggtgctggtgctagggaccatcttgctacccgctgtcaccatgctgggcttcggcttcctctgccactctcagttcctgcgctcccaggcacccccttgcaccgcgcacctgcgggaccccggtttcacggccctactggtcaccggattcctgctcctcgtgccgctgctcgtgcttgctctggccagctaccgccgcctctgcctgcgcctccgcctagccgattgcctcgtgccctacagccgagccctttatcggcgtcggcgcgccccgcagccgcggcaaatccgggcctcaccagggtcccaggccgttcccacatcaggaaaggtctgggtctaatgaccctcgagtcaagaacaacctgacggctgccctccctcttattcggcccaaggacttgaagcccggcatcttccgacctgccctgcccccacccctgcctgagcggagtcctagcatccccttgggagcagcagcgtcagtggacccagtgctgagaaaagcccccacatcccggaaaacccactttcctttcacgacccacatctcaatcctgaacatctaggctggaacctgcacacctccccctcagctccgtcgtgaatgggacaacaatctcgtgccctcgttttatggtgcagcttctctagtatttctggggctggggggcggggctggaggggaaggagtgtccacgcatcaataaagatttaacgaactg

SEQ ID NO: 1259 - DNA, 457 bp, Homo sapiens
agacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaatg

SEQ ID NO: 1260 - DNA, 487 bp, Homo sapiens
cttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgaa

SEQ ID NO: 1261 - DNA, 800 bp, Homo sapiens
accctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgc

SEQ ID NO: 1262 - DNA, 503 bp, Homo sapiens
ggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctaacc

SEQ ID NO: 1263 - DNA, 746 bp, Homo sapiens
atgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaa

SEQ ID NO: 1264 - DNA, 412 bp, Homo sapiens
gaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccag

SEQ ID NO: 1265 - DNA, 774 bp, Homo sapiens
ggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatg

SEQ ID NO: 1266 - DNA, 516 bp, Homo sapiens
cccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgtgactactcagctctgccattgtggctgcagagtgaccatagaccttctgaaagtgaatgagtatgactgtgttccaataaaactttattgacag

SEQ ID NO: 1267 - DNA, 427 bp, Homo sapiens
tcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 1268 - DNA, 1519 bp, Homo sapiens
ctgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaggctgctacaaccttggccactctgtttctccaccccagcactgggcatggtaattagcctttccccatgttaatttattcagttttttcaagggtcaactgaatccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtttccccttaccagctgggtccccttggatgggtctgtcaacatttaagcctcagttccctcccctgtaaaaatgagggtagtccctccctcataagggatattgtgaggatggaaagcgaaagtgttagaaaatccctcccaagggcctggtacatagtgggtgctaaataaacccctttttgtttg

SEQ ID NO: 1269 - DNA, 475 bp, Homo sapiens
tctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgt

SEQ ID NO: 1270 - DNA, 557 bp, Homo sapiens
gcatgcactgtctcagccaacccgctccactacccggcagtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcct

SEQ ID NO: 1271 - DNA, 608 bp, Homo sapiens
ggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatgg

SEQ ID NO: 1272 - DNA, 592 bp, Homo sapiens
gctgaattttctctttaatggccattggaagagtctggttcagtttttcccaactctcttcccactcgtatttggggcctctgggttttctgaaggcacaaggactgtgactttgtaccactaacctgtggttcaaacctgggtgtgtttctggcatctccctaacccagatcagcaatggccaccctgctcctctgaggtcagcagaagactgggaagcagaggtgagggatgcaggccacactggaatgggaagtcttttccccactggatgtgcctgtctggtgggttttggaccttcccagactacatctctaggagaggcctgtttggagtagtacactgagagaccctggcctcttctgctggaagactgtccaagtcttggggtttcttgagctggtgattcctctgccatcctgctctctctcttcatctcaggcagcatggggtccacttttgtccccaaacctaatgttttaatccaaatgcaaattggttccacatttttactggagggtaatcagtttttaaaattcacacacatgtaatcgaaacgcaatactataaagttctactggtgagactcctg

SEQ ID NO: 1273 - DNA, 1372 bp, Homo sapiens
tttgtggtgtctcaatgacaaatatgcagatgccaccctcctttgtctaatgtacggtgctttagggcaactatttaatataaagcaactcagaacttgtttcaggaagtgttgctctttcgccttacatgccaaggttctagggaaaaagctgaccatatgtaaaaacattgatgctcaagcacataaagaattacattctttaaacatagagtacataggatcaagtctctgcacaataattgagatgtgttatagggaaaagtgagcacagtgctattgtccacttagtcttggtgaatgtgcagtaggctcacccctaaggaatctcatgttgcctgcagtaaaaataaaaatggactgctacaatgacatactgagagagttttaaatcatgctttacaaactgacattctgagctctgagacagcagaaaatgtatcaccagagcaagggaggaggcaaatgttctgaacaataattgaaatggttgtgattttatttggagttggcacagatccaagtgaccaaaggagttcaaggcccaaaatttagttatgctggattaattctgagagtaacaagcacatagattataatctaagaaaaccctttgtagctatgcatgtcgggagagcatctaacactaatggtgatgtttcccatgcagagactcagattacagtgactcttccagtgaagacagatgaaagccattgggcattgtacctttgttaatccaagctaaactaaccaaggatataggggtgtgtatgtgtctgtgtgtgtgtgtttgtgtgtgtgtacacatacatctataggtatgaatgagccaaaaagctgctgacttacagcttaggaaatgcaaagtcaagtttttcttttcaccctgaggcactcagtgcataaaggttcaagttttaaaactaagaatgtttccaaaagaccagcaatgttaaaagagtatttcgtgtatactagacgtgcctttaagcaataaaaattccaagagctgatcattattgtgcttccattttagaaaagtttatttagtaacaaacttcccagtgtagggaggtttttccttgcccttttgaacatgttaggttattttcttcctatcctggggccttaccaatgtgtaatgctttcaaagtttctatgaagcctgtgtggattctattttagcttatttatatattctcatttattttgaaggatattatacttaatttggttcagagtagtcgccaggttttgcacctgacaatggcacatattttttgtataactttttctaggtccttacccttttccacactttacatttgtacagtgaaagcaactgccagtggaggcctgaaatgtccaa

SEQ ID NO: 1274 - DNA, 532 bp, Homo sapiens
cagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccaaccctgcagaggcctgaagctgggcctgggcaccccattcactcccgttctcatttacatctgttttcctgttgtatatatcacctttgttgacaataaattatttttttttattaag

SEQ ID NO: 1275 - DNA, 429 bp, Homo sapiens
atcatgtaatttgtgtgattttttttttttagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatactttaaattgc

SEQ ID NO: 1276 - DNA, 473 bp, Homo sapiens
agtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttctcatttcagttcacattttctaagcatgatattcctactgatttccttgtagatattttgaaacagataagaaactcctccgtggaaattactgttaactagggaaaagacatgtttttttctgttcataaaagtaatgcgagttctttgtagcaaaacttggaaaatgcataaaagt

SEQ ID NO: 1277 - DNA, 748 bp, Homo sapiens
cgagggtgttcaagcagttaatggttgtgctaactcttgtttctactgaagcgggttttgcaaagctgacatcccttaaagataacttgggctttcggaagcggcaaggaaatggcacccgtagttgccaggacaggtggtgtcctcggccaggactaagagccagctcatctttgtaacattcataatacgggaaactgaggaccaggtggctcggaaaagagatgagttccagcttttacctaacacagggttctctcgtcgtcccccaacccctccagctcggcttctttgtgtccagggttgtagatttttggatagaggtgtttctgattctagtgagtctgagaactggaaaagaccaaggaggggttgatgatttacaaggtccatagaaaaactttttgtgtggtcggaagttggccaagcagaggcccacagcctgatgctactgccccccacccccccaaagatctgaattccctaaagatcaagagggttcagctggccttgggagatgtttgctggagaatgacttcagttttctcctaaggcaatcagattgcaaccattagcattgtatcttatctgcaaatcagtttactccgaggttccccaaggatagttttattaggaccacaggactttactaaccactgaggtaacacgctgcttgtgcagcaattattttgaggtggaggtatttatgggacaagtttataattccatttattaaagggactaacct

SEQ ID NO: 1278 - DNA, 552 bp, Homo sapiens
tctcgaactcctgacctcaggtgatccacctgtcttggcctcccaaagtgctgggattacaggtgtgagccaccacgcccagccaaaccttcttttattagtgaactatcaattaactagaacttaattgtcacccagcaaataggcttgccggttaaaggtttaactgatttccatatactttcctatctttcaaaaaaaggtgaaagaaaattttttaagattttttaagttgcccattataatgttctatcaataacatttcatagatatctgcattttttgctttctgtgcacttcattttaaatagttaacttattttctgtcatcacagaaaatagtataaatgagtttaatagaaatccacaggtgccagtaaaagattagaagattgttcagactgctaaattgcaggctatttggaggtaaagtactccttgcacagtaattccacctcttcaaagcgtccttgttcgtgagaaatatttgccagcactgcactacttagagacaatgaagtatcttgtctacagcttgtcaaaagaggtacc

SEQ ID NO: 1279 - DNA, 565 bp, Homo sapiens
aggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 1280 - DNA, 1017 bp, Homo sapiens
gagatccacccgtcttggccccccaaagtgttgggattacaggtgtgagccactgcacccagccaagtaatgctttttctgtgtaccagtgacaattttgacagctaaaaactcacagttgatcttgtagagaacagaatagattatgcaagggccgcagatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaaggacatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggagat

SEQ ID NO: 1281 - DNA, 369 bp, Homo sapiens
cccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataa

SEQ ID NO: 1282 - DNA, 745 bp, Homo sapiens
aagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttg

SEQ ID NO: 1283 - DNA, 520 bp, Homo sapiens
atatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaacattttaatggttgtaataattatttgtatagatatgaatatagtattttatttaagaaaataaactttgcatttttgcattgt

SEQ ID NO: 1284 - DNA, 500 bp, Homo sapiens
gcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctttc

SEQ ID NO: 1285 - DNA, 453 bp, Homo sapiens
ctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattctaaaagcct

SEQ ID NO: 1286 - DNA, 886 bp, Homo sapiens
attttggccaagggcagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggacgcccctcggaacggcagcggggtggccttggagcgaagtgaagccaacatcaagcacgagcgatgatgacaccaaatccatgtgtccaccccgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcactctgctcagatacattgagtggcgatttttagttttgttttgaaaaaataaacagattaacctgc

SEQ ID NO: 1287 - DNA, 532 bp, Homo sapiens
tagcagatgattttcatctggctgcctaccgcatgctgtactataatgatttagttgtgatatggatttctctctgcatcgaaaactgtcttttgatgatcagacaatgtttatatttagttatttattctatccatgtaaggcatttttgagttttcttgtcactgtttgcatgtatttaatcagaatgtaatataatttatgttgtcaggtttttttttgtttgtttgtttggggttttttttgtagaaatttaggtagttagagcttttaagtctaatgtcatattaacttaagttaaatttccagaacgtagatatctgtcttctgtaaaaggaaaataacgatgttaagggacagtgaattttttttgaatactttgtttctcattgatttttattgtaagtgtaaaccaagagatgcatttctctggagaagtgtttatctcctggattaataaaatcatgctaaaatatgcgagtaatatgtattgcttttgtaataagaacataaaataaaattatttttaatt

SEQ ID NO: 1288 - DNA, 625 bp, Homo sapiens
gatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccctgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattct

SEQ ID NO: 1289 - DNA, 466 bp, Homo sapiens
gcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtag

SEQ ID NO: 1290 - DNA, 430 bp, Homo sapiens
tccaggggattaggtttggggtcagaggttctgttttccaggggaggggtgagataggcctggatcatgccctctgccatgccctccagctaggaggatcttgagtcagagaggattggaagtgctttctcctccacccaggtgaggtcaggggagcttaggtcttagggagatggcaagttgaggtatgaagggaagctggggcttttggagctgccgaacaactgagggacccagtgcgccttccatcccgcactagtgaatagcgccccctcttcccccgaaaacgaggtgcgagaggaacaattcccacgctggggaaggacttgtctccttttctgtgaaaatgctttgtaaaaagttgttattgtttgcatagagcagattcttgagaaaaactgttttggaccataaaagttttgtttgtttt

SEQ ID NO: 1291 - DNA, 635 bp, Homo sapiens
tctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcaatggctcacgcctgtaatcctaacactgggaggccgaggcgggtggatcacctgatggtgaaacctcatctctactgaaaatacaaaaattagctgagtggtg

SEQ ID NO: 1292 - DNA, 996 bp, Homo sapiens
taaaatcaaacagcatgatttagaacgtcagtcttctacttaaaatgtgtctatattcatggtatttccattcagtgtagatggtaaggaaaacatctagtcattaaagatttacttatagcagactccagaacactacctacaatggggtttcagtgactagaaatcttgaaggtttatgattgcatcaaattgagcctgtactaatatctaaatatctgctcttatgttctgctttatcccttgggattaccttctaaggtttggtcacaccagcaaactgaaacagatcttaatgtacataaaaaatttatactaatattactcatctgtgttacagtattttgaaaaatgtttcaggtgtcatctagtcgtctttcatgggtgtgattagttacaaatgttatgcttatgttttcatacttaatatcaagctttctttgtaccttacaagatagtatttttggttctaaaaaaaacaagcaaacttcatttttgtagtatccagaaattacctggagtcagtatttttattcgccttctagaacttgtgatccacacatcacccatttatattagtggtaaaattatctgctaaaatctaattgtaagaaaggcttaccttctgtcatcaagtgattgtatcatcctggatcgtcatttccaaggaactagcctttcttttcctaagcgtctgtatgtgttctaaaacttccagtatatatttatagaacttagaaaaaatgttacattattcagagtagcaagtcttactggagtacctatgtttgttttcttggtttttatttttttttaagtttaaaagtagtaattaaacctatattttgtgattgtttcctggtctgtgtttttaaattcttttccttcagttttcctcatgaagatgtttcagatactgaatttgtttagacattgaatgactttgttaaaggcacaattaatcacattggttgtactctgaagacagacttcttt

SEQ ID NO: 1293 - DNA, 427 bp, Homo sapiens
gaccccattgtctatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaacaatctaccaaaaatttcaaataaagtcaaaccccccac

SEQ ID NO: 1294 - DNA, 556 bp, Homo sapiens
caaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatgcagtttttccctctttaaaactcgccagcttttatgtagtgttttataaaattacaggaataaaaagaatatcttttatgcttttt

SEQ ID NO: 1295 - DNA, 868 bp, Homo sapiens
tttattgcgggggagtgatctctttacatagcttcaaatggcataacattcagcagtatccaagcttagatatatctgatgagaggaaagtaattgtgaggcctttgttctagttacaactttgtcactatctgactccatgactccagcaaattgcttcaactgtctggcctgcagtttttttcttgcgttaaataacagacttagtctagatcggtggttcttatcatgtggtttctggactagcagcatcaatattacctgggaaacttgttagaaatgcaaattcttgggctctgcctagacctactgaaacatactctgtgggcggggccagcaatctgtgtttgaaacgcgattctgattatttgacaaaagtttgcaaaccactggtctagataagtagctcttagccttggctgcacattaaaatcatctgggcaacttttataacctaccaatcctggcctcttcctccaaagattctgacttaaatggtttcagatggggaccattgttatgcggttatagccgacgtctaggtgctacctgaggtcttcaaagctaaaggtcagtgtttcccagccgtaaatgcatacctctagacctggccttctcaagccactaggtgttgctataatagagaagaaaaggcattttcagaaccgtctttggatatggatgaggaggaggaaaatgtatttcttagcttctgataagagattattttgttattttaatctgagtgcaatttgctaaatattcatttgcaacttgttaaatttattcaaagaaattaaatgcccataaatgacagaaagaataaagaattgtgatatatatttacaataaaatactctttagcaat

SEQ ID NO: 1296 - DNA, 811 bp, Homo sapiens
cttgagccagtattactgaaacaggataaaagttataaaatctaacataggttaatgcaatgtctctgctagtgctacaagtctaaaatatctttgtaacaatgctttcagaaatgccagttttaattacatttcacattgtatatgagagatactgctttatgaatgaatcggaataatacattttcatttaaatcttaattgcttttcattaaatgcgaagtcttaatttcaaaatgaaatcacactaccagcaatagacagttttcttgaaaactctaataaggaacaatagccagttccgtaaataactttaaaattctaaaagtgttggtacactagcaatcacaaatatggtttcttttaatacttttttaatcctgtaaagaagggtttttataaacattctttttattaatcagtcataacatggcgaagtgtgtagttgctgtttctgaaaagtgatccaaactctacatccagagattatgaaaaattcttatagaattttgtaacaagtatttacatgttgggtgaaagaaatttcatagtcgttggagtgccatgaaattaatacttgcaattcagattgcggtagtttacactttttctgtatgtttcaaatcaggtgtgtaccatttgtactgagaacaccacagaatgaattatccaaagtccattgattttaatacgtgttttggtttgtaaacaaattatagtaatttcttgcacatttttggaaattaattgtataagaatttatgtatctgcttctagatacagtgtgtaaataaaaaatttcgttcacaag

SEQ ID NO: 1297 - DNA, 587 bp, Homo sapiens
gaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatc

SEQ ID NO: 1298 - DNA, 588 bp, Homo sapiens
gaccagaatatcaaatgtctacacatgtcagccaaagaagagatgcagagggttgggtggggctggaagcagataggaggggtctccagggactataggagtacaatcaacttgagtaatcacctgcttttttccccaaaccctgtgtggaatgcagccagctagctggtttaaaccagttcatgacagacctcagcaatttacagatggatcccagtgtactttcctcattaccatgctagtatcttcaccctgggagatgctatagcttcattaccataacatgtgacctgtgtgctgaaataacgactcactgcatctgcacaactgcaacccctttccatgcaacgacataccctcttccctctctatcaccccataaaaccctcctgtcactttcctgctttggagactatgcccggtgctttatttgtgacaagtaataaaactattgctcaaagcctgcattcttggttggttatagtggctcatgcctataatcccagcactttggaaggctgaggcaggaggattgcttgagcccaggagttcaaaactagcctgggcaacacagacccccttctctat

SEQ ID NO: 1299 - DNA, 893 bp, Homo sapiens
ggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccatcctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatgttcgtggaagggccaggagttcctgtgaaaccaggatactgcagctttattaaagttaaagaaactgtaacatatctcttatatattaaaaacgtttaaaagtttt

SEQ ID NO: 1300 - DNA, 395 bp, Homo sapiens
cgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgttt

SEQ ID NO: 1301 - DNA, 534 bp, Homo sapiens
cctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaatt

SEQ ID NO: 1302 - DNA, 520 bp, Homo sapiens
gtctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcag

SEQ ID NO: 1303 - DNA, 613 bp, Homo sapiens
ctcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtcgccggaggggctgccttatatttgaaacatgctttctatcatgcattgactgtatgcattttgttaatgcacattctgtttgtttaaggtgtgtaagatacacacccttctagatgaaactatatgtgccacactttgcactactcatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgtttta

SEQ ID NO: 1304 - DNA, 706 bp, Homo sapiens
tctcagactgaaaaggacttctcagagaagcattcgaccctggtgaatgatgcctataagaccctcctggcccccctgagcagaggactgtaccttgtaagctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaa

SEQ ID NO: 1305 - DNA, 771 bp, Homo sapiens
tttgtatggtaaagacggagtttcaccatgttggccaggttggtcttgaactcctggcctcaagtgatcctccccctgcgctcgcttcagcctcccaaagtgctgggattacaggtgtgggccaccacgcctggccaagagcctcactcctgtctttagtgattgcactgaagcaggcctcatttttttgcagtcatgctaaccacaagttagtcaacattcactaattgacattcattagaataggtctccaaggtgaggcataacgttggggtgtaatctggatttcgcagtcatctttttggggaaactgaaagtaccatctcatttgcatgaagtgactccacactggccctgtatatggactctggtaaaatgtgagtgtggtacagaggaaataggtaagacccccttatctagccctctcggcagcagcgggggggtgttacaaaggactagctgttcaaatatcttttgtattgtattgattcccctattgaatataaatatttaaagtataataactatactgtaggtgggcttatgagtgttctaaatatctaatagctaaattgaaataagtagaaatataaacaatttagcagctttctgtaatacatttacactcaaattataagcagctaattctaaaaaagatgtcactgtaaactattgagaactatagtattttatatataattatatgttcatgtatttgaacccaaaataattttaactgaaatgctttgaataaagtatactgtaaatatc

SEQ ID NO: 1306 - DNA, 1021 bp, Homo sapiens
caaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctgggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctccacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtatta

SEQ ID NO: 1307 - DNA, 875 bp, Homo sapiens
gatgtcatatttttatttacttgatataattttaatgagggcaaaaatcctttgaataatctcaatgaaagcagtttaagcctaatcctaataaatgaattcgtatactttttttgaccttggaaaaataccactttacacccagtgctacgtttgataagtcatagagaagcatgcacgcataaagtgaatggaaacagaaacgtttaaagattataagaacaattcaaataggaggaaaaacaaactgcaggaaactggataggaagttataaaaggaatgggagaaggaaaggcccagctcttctgtaaattagaatcctcaactaaaatagcaaatgagattgaagaaatttttattcagtggcccccaatggatcagtgttcatataggtacaggccaagtgttaactatgttataattgccatagaagtgtgtgtcaggagctgaattttactccaggatgacgttgttgaccacatttgtagctgtagtccgggaattggtttgaaaggaaattggcattttcatgttgccaaaaatcagatatggctattttgtttatataccgtaccttaaaatattaactgctttttagaaaccaataaaaagtcttgtgaaatgttaaatgataaagttgatcattacatttgttaccaaccttgttagtcaatgtgacgtgacttttttcatgatgatgttttcacttgaaataaaatgagctttagggtttggcaaatacctttaaaatgtaatgctgaaattcaactctaaccagttctgaatctatcgtcatacatacacatcatctataacaatttcttttactgaaatgattgcttaaaagtatgaatttcattaaatttcctattgt

SEQ ID NO: 1308 - DNA, 461 bp, Homo sapiens
accagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcgctacactttagttgtgaattttttaaaagagcagtttaaaatcaggtcattctaccagcttttgatgattagctatgaagtcatactttttaaagaaaacttatttttacctgagagatcaataatatataaaatgttgagtgtgggtttgtatctaataaagtatgccaacacctg

SEQ ID NO: 1309 - DNA, 718 bp, Homo sapiens
atttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaatt

SEQ ID NO: 1310 - DNA, 1279 bp, Homo sapiens
ctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatg

SEQ ID NO: 1311 - DNA, 553 bp, Homo sapiens
atttttatttcaaatctcttcatggcaagttgggctaatggactttgcactcaagaaaggtttgtttaccagttttgtagccatgtttggcaaatcttagcaactagaaaccccgtcctttcttttccttctttatatgttcttgcagttactcttgtattgcaagattttctgactttaagctttgagactactgcatcttaaaagaagaactaggctgactggcaaaaagtcttgccagtggccctgtcactcccatgatgctttggttttgagagttgggaaaactctgagaacttaagggaaccaaactcaggaatcccaaaattggtggcattgtgccattcgtttaggggctgaacataggacctgtctgaaactgagtgagctagatgcatttgggtttgaatttttgtcacatactgaaatgtaagtcagccctaaataatcaaaacactttattttatttttctttttttaaataggaactttctgaagaaaaagtggtgtgtaaaacatttgatatttaagacaataaagtttttatcataag

SEQ ID NO: 1312 - DNA, 1372 bp, Homo sapiens
tggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgttacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggtatagggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttctttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcag

SEQ ID NO: 1313 - DNA, 1220 bp, Homo sapiens
gcagaagcacagcaccctccgtaagggcaccgggagagcccgggagtgcgttccggggctttcggagcagcggtgtgaggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcttattgtttcttgaaatgaattaactatccaggcaaaaggttaaaaatgaaaaaaaagtctttgtaactaaatttttcccattttgttgtgtatttgaggagttacaaatcaaaatgtcctgggttaaaaggcatcacatgagtttgtgcccaatgccttttcagtgtgaggagtctgatagcagcccatcccatttgggtgggaaggttatagaccttgcacattaatgccatgctcaaagcagatttgcaggtatcctgcaacacagggactttcacaaaacccgctttagcttattctacctgaactacttattttaattaactaaatggatatcccaagcattccatgtttatcctgttgctcagtgaatcctcaaatcgttaatttggtagattctcttttttgtcttcatactattatttcttttagcttttaaaaaaattgtgtactgcctacaggtctttatggaagtttcacctttctttgtgtcgcactggcatcggctgtataatttttgcagctagaccacattttaaaaaaatctacatttttggaactagt

SEQ ID NO: 1314 - DNA, 943 bp, Homo sapiens
cttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaagttgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgagattccagggtaggaagtgctgtttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttcccta

SEQ ID NO: 1315 - DNA, 548 bp, Homo sapiens
gctgtgggtattgctgcggctggtgcgtcgtcgctctagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtttccttgctacttggtatcttgaaatctggtacgaaactattgcatgatccctgcacctttgcttctgcatatatcatagctctcttatagtgagtgtgcacaatctatttcatttgatgtaatcaaagtttaatatattggatagttaaaaataaaatacaactttaaatgcgc

SEQ ID NO: 1316 - DNA, 487 bp, Homo sapiens
cctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattgat

SEQ ID NO: 1317 - DNA, 397 bp, Homo sapiens
tgggggaaaattaaggtttgaggttttagaaattagcaagtagtgcatacccttctagccacaagtgcccagtccaggaaagtgctgacttcttagagaatgtgtggccagacccagggacctggagtgtgtttggactgcagtttgccaccctgagaacaccttctccaggactggcatttcagaatcagattcttcattttttgcagctacgatgttcttccagggcactgggggctgtgacttctctctaaattgtatataagttgtgtatatagagaccataattatatggtccttagaaaagactttgcttttataaagcatttagaaaaaatgcatacttttaaaacaagtgcttgagttgtcacttaaaaattatagcatattgctataa

SEQ ID NO: 1318 - DNA, 1176 bp, Homo sapiens
atgactgtgcgggagatctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaatt

SEQ ID NO: 1319 - DNA, 533 bp, Homo sapiens
tgttgtcatttacttgggtctgtgcatggcgtttagaaggctacaccttaggctgggggtcaagaatgtcttccctgatgtgaggtttacacagagatctgaagaatgaagagtccagctaaggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgtttt

SEQ ID NO: 1320 - DNA, 991 bp, Homo sapiens
gaagcctgctaatcaaatactagatggtcttctgaagagccaattgactaccctcagttttttactcaggagcaggaatcaacataagtgtcattgaagagtgaggctgcagaatgtaactgaagtccttaagatatcttttttttttcaactttgatacttggatttttctgtttgatattaccagtcaacccctgctactagtcctgaaagagtcctggaagtgaacaagaataaaagtatgtcaaagctaaaacatgacccaagatagaagcaccttgtaaaatatgattaactgtctgtgccactatgacacaatactgcaggctgggtaacttataaaccatagacatttatttttcatagttctggaggctgtgaagtcccagatcaaggtactggtgggctgagagtctggggaggcctaccctctgcttcccagatggcacagccctctctggaaaggacaaacactgtgtccttacttcacagaaggggcatacttcccctgaagcccttttataagtctgtaatccattcatgagggccccaccctcattgcccaataactttctaaaggccttatacttcttaatactgttgcattggggattaagtttcaacatgaattttggagtggatacacacactcaaaccatagcaaatattatgaattgtgttttgtctacaactgcctttacatttagaataatttttgtataaatgtagttaaagaactactcatctctttcctagattggatatagagggtttttttgaaaacccttggaacacaatttttatttgctttctttgctacagtagtaccaaagcagtagatttaaattagacggtagtctaatagacataaagtagtagatacgaagtagatttaaattagagattttaaaacagtgtatttttatgtaagtagcttagccaaaaataaaaaaaattacatatgtacttggaataaactgatttggaaagt

SEQ ID NO: 1321 - DNA, 408 bp, Homo sapiens
gcaatttttgttttgtttgaggaatacctgtcttggattccttagccccttgccagtcctggagactgtggcaggggccgccaggaaggcagctgtctgctgctgagtcagatcggaaggtggtgaatctttccagagcagctgaaaatctcagcatggagacagtaagaaaagagacggggtgtggataagactctgccaccgtgtcacactagcataggaggctgcacgttcatttgttgttgtttttttttcctttgccaacctccgttctatttatgtgcaagcagtttggattcaagttcttgtatctgtctgttctgggacctggggattgtgagggttccctcacagccagcacgacccccagaaagaggcgtcccacaataaacacgtcacctgctcttg

SEQ ID NO: 1322 - DNA, 696 bp, Homo sapiens
tgctgcagaatttgacccagatgggggtgttttttaggtctctcacaaatgagacaagcgaaacaattgtctccttttattctctttggtgcattggtgctggggaaacatgaactagcggcagtgtaactcagaacatagacccagttctaccaggccagggcagcactggggaccgccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggtta

SEQ ID NO: 1323 - DNA, 787 bp, Homo sapiens
gcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatgcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggct

SEQ ID NO: 1324 - DNA, 1052 bp, Homo sapiens
gccgggacttgaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactc

SEQ ID NO: 1325 - DNA, 536 bp, Homo sapiens
gttttggctgtcgtgactggagggaagtggtgctcctacatctaatgcgaggaggacagaggtgctgctaaacatcattcccacacaggacagcctcccgcaacaaagaattgcctggtccaaaatgggtgggaaagcctgacttagaggcttagggagttttcccctcctgctaaatgacttgaagcgattgccacatgggttacacataaaatgtgtccatggcatacagttctgactgtaaaatgagcgtcactcaatggtgacaggaaactggaagcactgttaaaatgggaagatatgaaccaatccttatctacatgacacctacacatctagaactttacgaatttctctcatgggctcctggatctggacatttacatgatgccaggcatatagctgtgtggcttcttgcaggcaaaattcccaagtgattgactacatctcttatttttcttccaggtgtttgtgtacagtttaagcaatcacagtctctgcgtagaaagatcttctcaaataaatattgcaaaaag

SEQ ID NO: 1326 - DNA, 540 bp, Homo sapiens
gagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaatt

SEQ ID NO: 1327 - DNA, 456 bp, Homo sapiens
gccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagt

SEQ ID NO: 1328 - DNA, 445 bp, Homo sapiens
gttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctgattcttt

SEQ ID NO: 1329 - DNA, 956 bp, Homo sapiens
tgacttaacacactacttcaagtatatggcaggtctgtataataaactcctgcctgtctagtcttcagcctcatagaaagcaagaaagcaggtggcgtatgttgcagaacaattcttgggtagaacaaggggacatttgatggtttgggtttttcagtaagaaagatgaagtcctggagtatagggtagagtggtacagtggaaaatatttcagcttgggggttagaaaataaacatgccgattcttgctttgccataaatgatgtcacctaacttgtgtgaccctgttttctcatccctaaaatgatttgataagtttaagattaggctatttttaaatgtatggaagaaattgggtgttacccttcttgaaagacattttccctgcaagtatggcaggctgtatctttcagtgtaacaaagttctattaaaggtcataactgctgccctgtaacttttgccttattctagaaacttctactccttgaatgacatgtgttggtacatgtttcttctctttcagatagaatggttaattttgacttgttgcttctgcacacgtgtcctggaaataaaagtttcttcccactacttattgctgatttatttcataggaagtcttaaggaaagaggcaaaaaacgggctcatgggtcacttgaagttggaaaattctgtggagattgacaaaggagactcacttttgagcatctgttctcagtgtaaccttcaaatctgtggaaacataactaggcacattttatgattatttagaatgttaataaattgctctgagtttcctcaagtccattttgtaagatcagaccataggtgggtgttgtttcttttaagtgtgtgtactgtgtccaatgttacatttttagaagtgttcatgctttttgtaaagtgattcgttttaagcacattaaaggtcgtttgagtattgtcatgtatttt

SEQ ID NO: 1330 - DNA, 853 bp, Homo sapiens
gactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaa

SEQ ID NO: 1331 - DNA, 522 bp, Homo sapiens
aatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatt

SEQ ID NO: 1332 - DNA, 1007 bp, Homo sapiens
cttaagaaatagaatatcataggccagttacattgtaactgtagaactgccagcagccttaccaagaaaatgcattgacaataggagagcataaggttacccctggagagaagcagatatgacaggaagattaatggtacacaagcccagttagtacctgttaggaccagttagtccctgagaatcaaaacatcactgtttactctgtttttgtaatacttcctaatataaagcaagtctgtctttaaactttttttactcaagacactttctgaaagaaaatatttagaatcatctctcttcctgccccttttaaataggatatttgaggattatgactgggtttggtattaaggatcaggaaccctgtagggtggaactgattcaccgaggtggcctgagtcattgggaggccaggtggcaaagccccatgactggggactcaggcttcacctgctgtcccctaagcagagggcggcccacaggatacctttccatacaatacatcaccaactggagaccatggtctgtgctctagtcatgtatgctccctctccttgcctggttgatctccttagcaactcatggtcttttactctagcagatggatgcctcatctagagactctggaggagctgattttctgtctgcccacccactaagggccttcaagctaataaagatagaaaacaaggcaggaatttttgtctgttttattcacagtgtatctcaaacacatgaagcagtccctcttcgtattaggcactcagaaatacttgctgaaggtacagttatcaaactgaaatctgagcatttttccttttgatgttccaagttatcttttgggtgattattataaataggtaaaatattgctataagttccctattcacgggtattttataaatttttaaaacttgttcttaatcttcagaagtgtacagaactgttcttcagatctttgtcaaccaaaacatgtattttcaataaattgagattcccagttc

SEQ ID NO: 1333 - DNA, 466 bp, Homo sapiens
ctttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaacat

SEQ ID NO: 1334 - DNA, 1055 bp, Homo sapiens
tacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcattttt

SEQ ID NO: 1335 - DNA, 846 bp, Homo sapiens
aataccttgacattgattttgcttcccatctttgaagtaattggttagttttctttgttcagccatttcaagttggtggttgggatatctgctctctgggatggcatcagttgggcagtcgtctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaacct

SEQ ID NO: 1336 - DNA, 430 bp, Homo sapiens
agaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgt

SEQ ID NO: 1337 - DNA, 482 bp, Homo sapiens
atacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacac

SEQ ID NO: 1338 - DNA, 434 bp, Homo sapiens
aacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgcc

SEQ ID NO: 1339 - DNA, 1114 bp, Homo sapiens
ggcggagtgaccacatagagtaaaaagaatgtaaccctctttggttttatgtgttttggctcaggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatg

SEQ ID NO: 1340 - DNA, 629 bp, Homo sapiens
aaaaacccaaaaaggtgtacagcgggacagcaagacttcccagaaagtttaaaatctctctgggtcttcgagtggaacctggaagccccgggtggcagtggattgatgtccagttcttgtcagaggagccttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcag

SEQ ID NO: 1341 - DNA, 914 bp, Homo sapiens
tggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttac

SEQ ID NO: 1342 - DNA, 1045 bp, Homo sapiens
taaattacagtatgactatccagtagactgttgtgccatcattataatttatgtttctgaagaatatttgacagcatggcaaagtgcttatagtgttaagtgaaaagagtgatatacaaaattgtatgtataaatccaaaaaatgacttttaaaaagatggaaaggatatgcaaactctgggtagttggattatgggttttcctggttttatgctttaaaaaattttctccagtatattactacttatattatcagtataacccgaaaaaatcaatagcatctagagctggcagtggagagattgaggccagatcactagtttggtccatgaacaattaactggctgggtggacacagaggctatatgatctttgtgttggcagcaaggctgggacagaagggaaaaggacctgcccaggaggagaagggaccgtgtgactatgtgaccataatccctacaaaaaaaacacaaagtgttaagggaagacactgtgggtggcatgctcttgtgatgtagtcgtaggtcggtaaaagaccacttatgaatcaagtatattctgacaagtggaaaaggatatgaatgctctcctgggtaaaattaacctcctttgcatttcattctcacattctcgcacaaaatgaattatcaagatggattttataatagctgattctctgaagaatccctgagactttgtatgattctttagtatagcagtggctttcgatgtgccaagtctacctcctcccatactgggacactcaagcaacacagatgtacacgggaattttgggtattctatactgagaatactgcacacatatcgttagtcatcttaatgttgtaacttaccaaactcttaaggtttgcaaatgtgattttgttggcatctagaaccagtgtattttttatttatgtctgaaaaataatcattgtggggttttaaaatgaaaaatcatgtagctaatgcctatccatagatgaaattgttatgttgggaaaatgtgtacttaatctttgctttagtaaaatgattattataa

SEQ ID NO: 1343 - DNA, 446 bp, Homo sapiens
cgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcgtgctgtgggatgctgagcacagagcccacagcccatctgcctcttcacctccctgaatccgtgtccatctgcaataaacgacagcctcggctgcctcgtgctgtgtc

SEQ ID NO: 1344 - DNA, 677 bp, Homo sapiens
agcaaagaagaaaaagtagaaacaaatgaccagaatttctgtactgctaaacttgttgaaatgtttctttggacagattaagttgatattgtgggttattatgccacatctccatgaaaatgcatacgttaatgaactaataagtattgcctcaagaactttccactatagaattctttttttatttaaaacatgtatgtatttaaaactcaactggtgacttgtgattgtgaaattgataacacttggatgcattcttgctctcacagaattggtgacatgctttgagagttttgtcacatgttgacatgccaatgttcttataaaccttttataaaggaatatatttttaaagtaaatatattgtaatgtactgtgaacttgtagggtgcttttcaacagtctttgtacagtgtaaatagatcatggaaataaaattacttattcaatattactattactgtataacattaacatttgaatgtttgtctgtgacaagtaccctatttgtcgtgtgacattttaagttgtaataagaagtattaccatttaaagagtgcctcctgtgttccaggtgctttgtgcatatattttctctgatccttaaacaacctagcgcaaggtattattagtattctcattttataataaagagtgcttgagtagcttgtctgatg

SEQ ID NO: 1345 - DNA, 816 bp, Homo sapiens
ctgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttg

SEQ ID NO: 1346 - DNA, 485 bp, Homo sapiens
tgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgag

SEQ ID NO: 1347 - DNA, 937 bp, Homo sapiens
gaatccgccgtgcaaatctgtccgcccccttggccactgatcccccgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcatacc

SEQ ID NO: 1348 - DNA, 550 bp, Homo sapiens
cccacggacgcagtcgacccctctgagcgcctcgggagccccgaatagcagctgggagaaggggcgaggactgagcctcgctgcccgctgccggccgggctagagatacgggcgtgccccccattgtgcgcctcccgccccccggtcccctcaccctgcggccacctggggcgtggggcggtgctcctgcccgtgcacgtagccgctgcgagcggaggcctgctcacctggtgcctgctactcactcccccgggccggtgggcgaaggacacccgcaggaactcggcagaggagaaattcagacggctcccgagggtaggaaaagaccccggcccaccgtggaatctgaaacacccgaccactctgccatcccatgtttcaccagtcagacccccagggcagggcaggggaagcagaatgcaaactggggcaccgtttccctgaagcgtgttggccgcgtttgtcgtagtgctagaggtgcatacccttggaccccgaaaacccattcctgggaatttgctccaaggaagtaaagatgttacaaagatgg

SEQ ID NO: 1349 - DNA, 477 bp, Homo sapiens
gggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctaccaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagc

SEQ ID NO: 1350 - DNA, 821 bp, Homo sapiens
cgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttag

SEQ ID NO: 1351 - DNA, 549 bp, Homo sapiens
agctgagattgcactgctgcactccagcataggcgtcagaataagactctgtcttggaaagaagaaaaaaaattgttagcctaaaaccaactctctctaaatttaaaagagtgattatttatcttagtatttatagaagtatgagattatcagaaggtgcgatgcacaatgctcattattttatcctagtacaagacacgtataacatctaacagtaaagaagatggaatctttctataaaaacaattctgttattaatagttgactgacttcagtaactttgaggagtagaatgaaacttattaggcaagatctttccacatacactacattgtattgttcaaaattcatagaaattacttgcaatatattgatttaagccttatgtagtgactgttgctatatttgaagtagcatttttagtttgctgtttttcctcactgcttaatcctacaaaaaccagccatctgcctaaaaaataaaagagcaaaaatgaatcagtgcaaccggtatacgaaaaataataattattaataaaactgtaaaggg

SEQ ID NO: 1352 - DNA, 905 bp, Homo sapiens
cttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgct

SEQ ID NO: 1353 - DNA, 688 bp, Homo sapiens
acaaaggatggcttttactcagcaatcatgtgctgaacatctgctacattccactcttagcactagtgaaacaaacgcgtacgaacagagccccaggcctcaaagctcacaatggaggtaactggtttccaggttaagtgcactaaactgtgtggaaggtgttatgatagtacctctacaggttctgatggaagcatcaatgatggatttggcttttccatttgggagaggaggctataaaaaaccttcctggaggacgtgggctcattctgattcacagacaggtccagccccttcacttcttactttgaactactccatctggaatcatagaaactcattagcagctaagtgagtcgtagaccctgttcctacagtttcaacaaaccctgatggtggcatttcagtttatcgtagaggtttcttttcccctacaagggtcattctctcttgcccaattttggctgagaagggaggaatatcatggccgttttggctgtatggtgttactgtataatgatatggggattggtgagtgaaaaataaaatgaaccctcacttgcttaggtaccagttttatgtaagaagaaactcacagcttttgcacattatttgagatttgcttcttctgtttaacatatttgtggtactttcctaaaaagttttgttatagacagctgtagagatt

SEQ ID NO: 1354 - DNA, 1005 bp, Homo sapiens
cttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttgtttggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttg

SEQ ID NO: 1355 - DNA, 548 bp, Homo sapiens
cccgagctcctgctcagccttgtgccagccagactcgtatgaggctcccccctgccctgggccccttccccactgccaaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcgc

SEQ ID NO: 1356 - DNA, 1009 bp, Homo sapiens
ccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactac

SEQ ID NO: 1357 - DNA, 472 bp, Homo sapiens
gctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctc

SEQ ID NO: 1358 - DNA, 1074 bp, Homo sapiens
ctttattccaatgtgagaaatggaagtgttttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttccggaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccac

SEQ ID NO: 1359 - DNA, 687 bp, Homo sapiens
ccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcacttactatcaaa

SEQ ID NO: 1360 - DNA, 759 bp, Homo sapiens
cttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 1361 - DNA, 1074 bp, Homo sapiens
ctaacccaattaaagcaacagccatgaataatattggccctgaccttgctgaattcaaaaacaaggttaattgatacctaccataaattctacctgagggtttttaaggaccatggcaattcctggcaaaaagctagagatgtttctaagaaacagatgacattcatttcatggtttatggtgcttgaaatttagaactgttctgagttcacgtagcaaatgaaagttttacaactgtactaatgaacaaaaaccctaagctttgttgtttggctttttctgctaattgttttgtttgtaaaactgcctatcttaattttcttcaagcataattttaaatgacttaacatttctcttatacataaggatgtcctttacccaaaatgaggagatttggaactgaaactaatatccagggacacaacattgggtatcatcaaaggcccacctttaacatcaaggacaagttgatcactgagataagagctgatagttccatttttattcagtctccacttctgcctgaattgcccatgttcagtccatagagctactttagctccaggtgtgtcccggccaccaatcacatcaagacatgtatcactggcctaaaagggttaagaaatgattaattggcagtagtatgtttgctaaagtaagttgaattaggtcccttttatcttaggtaaacaagtcatagacatgaagtgtgtgtgtgtcttatctaaaaaaatactatatagtataatttcagtaagccttttttaatgtcttctttacggctgtgggtaggagatggtacagaaataaaccaactgaaatagaggtacttgtttttaataggatgtctacatctgacaacagatgttcaataaagatttggtgaattggaattaaatgttaaatccctgtttgcttaaaacgtattatgttgagcttggttttcttatgaaaacattgcatgatgggctaaagatatccagacaataattacttttaaaagtttttcatttttgaagcatgagaaaaagtagataatccattggtgatacaataaaacacagtttgaatgtt

SEQ ID NO: 1362 - DNA, 750 bp, Homo sapiens
  misc_feature 94: n = A, T, C or G
actttgtgtaaagcagcttctcccacagagctttccctgcattgttagtgatgtcgggcaaagcatcactctttaacctggggcattggcatcnatgggatatcatgggaccgcagccgctccgtgcactgtctctgcccccagaggaagccctgtccatggttcctgtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttct

SEQ ID NO: 1363 - DNA, 562 bp, Homo sapiens
gcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaatt

SEQ ID NO: 1364 - DNA, 523 bp, Homo sapiens
agctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggcc

SEQ ID NO: 1365 - DNA, 500 bp, Homo sapiens
cttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcatttcgaggcctttcccttgtatgcagggtgccagtgggagctgctatgtctcctgtgcagccagacaccctggacgaggcccttcccacctccccctttcctcacggcttcttcagcaccacatgtggatgcctgtgggtcagtccatctgtccatgggcagggggccgctgtgagagaccccatgcgcgtgggatgtggtagatgctgattatggggccagccacccatacaggtctatcaggtcgcaatggaggccccactgg

SEQ ID NO: 1366 - DNA, 599 bp, Homo sapiens
tctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatg

SEQ ID NO: 1367 - DNA, 767 bp, Homo sapiens
ccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatct

SEQ ID NO: 1368 - DNA, 805 bp, Homo sapiens
catgcttaccagctctaggccagggcagatgggatatgacgaatggactgccagctggatacaaggatgctcaccaagcaccaagttctcacaagttattttatgtgactttgcaggaactgaggcattatatctgaggacaccaggggaaaagtgtggcatctcagggaaatacagccctgggctgtgtctacacacaccatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctccccttttccacatgtcttttcctgtaggaacactttctccatttattcctgcctatccaattcttccctatatttcctggaccagctaaagtccagtgtttccagagacttttgaaagtcaacttacactttttccttcttcattcacaaagctcttcttccctgggccctggtatgtatgcctttctctcctactgtctaatagcacctcgtaaattgtcaatgaacttttctaaggggtattcttgaattcccaactagattgtgagcttctggaagacaaggctatgtctttgattgttgtctcccctaccacagcccagtactttagttacagaaaataataaatatttactgattgattga

SEQ ID NO: 1369 - DNA, 964 bp, Homo sapiens
ccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactgtggggggggggggggggggggggggccgtgcgtaaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacgtcaggtatggaaggctttcagttttaatatggctgaaagcaaaggataacgaattcagaattagtaatgtaaaatcttgataccct

SEQ ID NO: 1370 - DNA, 850 bp, Homo sapiens
aactatggacagttatggctaatcctagtagattgtcttcccttttaacatcttggatgaatttgggtcacactaattgttatgtgaagatggatgttgaattgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgacagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccagggatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgct

SEQ ID NO: 1371 - DNA, 817 bp, Homo sapiens
tgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcat

SEQ ID NO: 1372 - DNA, 799 bp, Homo sapiens
gaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatg

SEQ ID NO: 1373 - DNA, 1339 bp, Homo sapiens
ggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaaaattt

SEQ ID NO: 1374 - DNA, 582 bp, Homo sapiens
ggaatgtgtttgacttcctcaatgaaaagctgcaaggtcaggctcctggggccctagaagccggggcgccccagcggggaggaggagcaaggacatgtaccatgccagcaagagtgccaagcgggccctgagctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtc

SEQ ID NO: 1375 - DNA, 546 bp, Homo sapiens
cagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgt

SEQ ID NO: 1376 - DNA, 919 bp, Homo sapiens
ataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttg

SEQ ID NO: 1377 - DNA, 691 bp, Homo sapiens
aagtcaaagactcagaaggcagcctgaatccagggcctgggatgcagggtttgctggaacgccagccggtgcgatcgcgcccctgggattccgcttagcccgcgcgtccatttccctgcatggtggactcagtaaagccggatctgtccaacgcctgcagcgtggatgtggaggcggactaatcaactagtgctctgttattatttctacccatcccttttctccatgctaatttgcttagaactttaacattgaatggacagcaaatgtcatgttctgtttaattatcactccttgaccattatgttaatttctttccctaacaaggtgacgcattgttttaagtaacaatgaccaactcatctactcttcttccaaattgtgtaaattgaagggtaaaatgtgggaaaacgctaaatttgaatgctaaatttgaacatttcacacaacaataatttgaaatgcttctttgcaatattatggcgtttcggaacagataaaaatacttcattttcagacatttggtcaacaaatacttcttggacgtttatatgcaaagcaatgcatgtaacattttcattactttgcaagtgtgcttatcagtaaaagaattttgttttaaattctagccttcgtttaaatgtattttagttaccacattgggaagaaaataaaatattactatgtacgg

SEQ ID NO: 1378 - DNA, 918 bp, Homo sapiens
tatgcacttcaggtatccagtgaattttgtgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaatcttattttctaatatgtctcaggtatttttatgacttctactaaaattcacactgaaactttatcttctaaactggaatcattacttaattttaactaaccaacaaccacaaaagcagcagctactgctaaatattggattactgacaaaggaattcagttttgtggaatctggtgtttgcactataggttaagagttgccatttaaatgtttcttattcataattaggttttgttccgctttagaaaaaaataaattcccaaatgaattgc

SEQ ID NO: 1379 - DNA, 822 bp, Homo sapiens
cctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacgtggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcctgtgcagggcacctgcgtggctgacagccaggctcttactccagccggggctgccagcgcatccagccagcccagccctgtgaaagatggagctgacttgctgcaggggacctgatttatagggcaagagaagtcacactccggcctctcagaattcacttgaggttcaattaaatacagtcacaccgccccctc

SEQ ID NO: 1380 - DNA, 464 bp, Homo sapiens
tgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagc

SEQ ID NO: 1381 - DNA, 545 bp, Homo sapiens
ttttttttttacagcaaaaatttaaggttttattgggggagggggtggtgctacttcctctgtaacatgtttttaaaactatgattatggtttttggttgttttttgttttgtttgtttccttttagtctgtttttaatatccttccccttaactcttaaggaaagtcttctttcctacagggctgtgaattaaggaatgggtagcgtttacatttaagtacaccaatgtctgcccaatttcctaatgtatacatttgttttattttaaattattttttgttcttaaaaatactagaagaaaacatagatgtttctagtgcctttgaacttatactgtagtctgactaatttaatgaataacttcagtagcattactataatactgtatgctggccaaaattacaaattacagtttgttgcatcagtttcaaaagccatgctttcattgtattttatgtataaattgtatttgttcaagttgtatatattggtattgtatgtatacatgcagcatggttaaataagaataaaaatcttttaccta

SEQ ID NO: 1382 - DNA, 742 bp, Homo sapiens
ggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgactcagggaaaatgacatttaatcaccggctaattaactccccttaccttctcctttactgcatccccacaccgtttcaggtcctttactttgtgcttatggaatcaaagttggtctgtgaggttttctctgatccagatgtattttattaatttaatcattgt

SEQ ID NO: 1383 - DNA, 885 bp, Homo sapiens
tagggaactgcagggtctagggtgttgtcggagtggcagttggtccgaatttctcccgaagcccgcggaggagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcac

SEQ ID NO: 1384 - DNA, 733 bp, Homo sapiens
aggccgtctacaccaccaccctggattacaactgccgcaagacgctgaggaggtttctgtccagcgtggagctcgaagccgcggacgtcccgggcagcgacgacctctctgatgaatgctgacccagcaggctgggctggggtcggaccggctctcccgctgtcctgcccccgactgccctggccaagctgggcgaccttacccttcacgtcattccagccccagaggagtctaacctagagatacctccaagcgcggccgggggaagagaaaaaaaaagaaaaaatcactgcatctcataattattgagatctttgtgttgtaattttcaagctgtttttagagggaatatatgtcctggtttgctgctgtgttgtttccccaaagtctcaatcagatgaggcaacaaaaagaccaccagaattgcaggaaagcagcagcagtctgggatagggaggggggaggagagctctccctccgtggtcagtttgtcagaagaaaagcatggaaaaagtgagatttaagaaatctcagccacgggtgtcttcactgcacaaaagtggtgctaattcagtaaacagtgacacctgtgtgggttcaatctgtggagagttgagttccattcctttgtttttaaatttccacctccatttgtgtttcctattaacctaaactcttgtaattctctaaatcttttttcatgatataaaaaaaaaagaaaatcccaaaccac

SEQ ID NO: 1385 - DNA, 615 bp, Homo sapiens
ggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctaggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgct

SEQ ID NO: 1386 - DNA, 437 bp, Homo sapiens
tctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactat

SEQ ID NO: 1387 - DNA, 555 bp, Homo sapiens
agactgtttgatgcccttcaaccacagctcagcaaaggctcctggggtcccgtctgtattgcacagaatcaaaccaaacggatccaccatccacccacctctcttttctgatttcaacagttcctcttatagaaatttatcatgagaaaaaaccaaatgagtacaaaatgtatgtacagatgtgttcccttcactcttgtttattccaactctcctcacccccaccaccaagagaaaacctggaaattcatcaacagaggacagactaaagtaggagtcttcatatgatgaactgctagagactcatttaaaaaacgataatacaaacctgtatttactgaccaggaaagacatccatgacatattgctcaataaaagtttaaaaggagattataaaacagcaagtatagatgtgtatataaagtattgggaaaatgttcaccacgctaacagttgggctctgggtattgggatttgaggtgattttttcttattttttgtactgctctaatttccagtgttcatttagcattataaataaagcagtaaaatagc

SEQ ID NO: 1388 - DNA, 471 bp, Homo sapiens
caagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagct

SEQ ID NO: 1389 - DNA, 477 bp, Homo sapiens
agctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagcc

SEQ ID NO: 1390 - DNA, 585 bp, Homo sapiens
ttgctagttggtgacagtgttgtgctgaagcaggattccatctactatgaacatttttacaatgagctgcagccctggaaacactacattccagttaagagcaacctgagcgatctgctagaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagtgagccccaaatccgagagggcatgaaaagggtagaaccacagactgaggacgacctcttcccttgtacttgccataggaaaaagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataataaaaccacctttattttaaagg

SEQ ID NO: 1391 - DNA, 489 bp, Homo sapiens
tgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 1392 - DNA, 752 bp, Homo sapiens
tatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaataga

SEQ ID NO: 1393 - DNA, 1145 bp, Homo sapiens
tgtgatctggactcagcctcttcagcgtggtgctggaggtgttcgtgggtgacggtgcctggtgaagtatcatgtgttagagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgagtgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaaggctccttggaggcagcgccccaccttgggcttctgagggcatcatagggggacccctagagtcagttcaccacaggccctggggagagtcaaagacccccgagggtgcccagccccccacactgtgactcctcacactcagcgatgacctgttgggtggggggccctgggacgttttttaacctgagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatg

SEQ ID NO: 1394 - DNA, 651 bp, Homo sapiens
taggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaagcaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaaccacc

SEQ ID NO: 1395 - DNA, 451 bp, Homo sapiens
tgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaatatttattaatctgtatgtgttttaaaataaaataacttatttctagctg

SEQ ID NO: 1396 - DNA, 1397 bp, Homo sapiens
caactcagctataatcctgagggaacatgggaaggaatcaaaggtaaagcccattcaggcattattgacaagagggctttaaacaagtgaataattgcacaactaaaaagacattagaactgtgtgggctataagtgttcttatcactgagacacagtggatttttattgaaaggaaccacgtacagcaatgcggagtgggatagggataaaatacccaccccaaaatgaccttggccacctgtctgccatatacgtacactgagttcctgtctacccaagagagtcagcccttaattctcaggtgaacaaacagctaactgcatcagcaaattggaatggctggcttgaagtttccattattttcttgaagagaggtgatgctttaaattactttttggattgtagccagttcagctaggcaaaagccatacttttcacaattaaacgaaaaaactattctgactagagtcaggtttctcatatccatcgtgataggaaggcctaagaatggcaaatcgctttgagatataatattgaacttcagtatgaatgtgaccgaatctgaaactttgggaatttgctttagccagaataaagaaaccaaatcatgaaaattatggaagactattctgccacctgtgccccaagttggatgagcaaaccactttggatcagttcacagcattaactacaagtgaactgatcatcttctctatattcatttcacaagagctggcttaggtggggtaattaaattgccaccttcgtggttgtaaaagacaaacaaaacatggcaaatttcattaacacaaaatttcatcaactgctatactgaattatgtttagaagattctgaaagcaagattatccagtgggtaaatgagagtcgactggattctgtcagttcaaaaaaggaaagaaacaaaacttccctacaattttcttcactaaaatttattatatgtacagtattcccactcctggcattttctggcaggtttaaaaatattcagcataaatccagcagaggtggctgagcttaattgcttaaataagttctagaaaatttaaaaatcattttagtagaattcagtaccattgtcactgcaataagtgggttttagaaaataagtgtgaaaagaatcaggtgttaatataatactaaggataaagctttagaagctattttactacataggtaaagaaaagataaactaacttgtaacaaagaccacaactgcatgttggattagattgtctcatatttcagaataaaatgtactgtatacttttcctcactttgttgtgcactgtaatgaaatgtgaaaaatgctttatttagctgtatgtgaatgaaaatatgcttgtatttagtaaaatgattgattatgtgac

SEQ ID NO: 1397 - DNA, 435 bp, Homo sapiens
cagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtc

SEQ ID NO: 1398 - DNA, 621 bp, Homo sapiens
actacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggc

SEQ ID NO: 1399 - DNA, 563 bp, Homo sapiens
aatatttttgctggagtcaggagcactgtgaggcacagaacatctcccagaaagcagattttttttttctgccgaaaaaccaatatatatatgtatgatcccaattaaaagacaaaagcaaatgagccccaaactgcctgtcttcagctttgcctgggagctgctacctttgctcttctagcatcttctaggtaccaaggatattagccacttgagggtgttgggcatatttgtttcattgtaggcaaaatcctcttgtggtttcccctccccaggtattgttgagtctgttcaaagctgggtgtgttgaaacactgcacaaatcctgccactcttgatgtgccgcttgtctcagccttggcagaggctgagtctgttcctgtgcccacctgtccagcaggttttgatgttggctcctgaaagagtttgtatttattttattttgcactagtcacagttgttgttaaactgtatcaaatgttttgggagattatttgcctgagatggaaagagagatggatgatttattgcttcaattgttttaaattaaaagctattctcac

SEQ ID NO: 1400 - DNA, 703 bp, Homo sapiens
agcagcagcccaggaggcctcccgcccgtactttcccgcgtccatccctctgtcccacggtcggtgagtcagcggacgctgatggaggccttgggctctgggcactatgtgggaggcagcatcaggtccatggcggcggcggccctgtctggcctggcggtgcggctgtcgcgcccgcaggggacccgcggctcttacggcgccttctgcaagacgctcacgcgcacgctgctcaccttcttcgacctggcctggcggctgcgcaagaacttcttttacttctatattctggcctcggtgattctcaacgtccacctgcaggtatatatttagagccactaactttgtggcatttgggggctcctcgtcaggatggctgacttccacccacctgctcacccaccctagagcaaagcgaccaactccgctcctgcatgcagacttgccactcattctttccattgcctcatcttttagtataaatgggtggcaaaaaaagaaaaaaacagcatttgtggaaagcctgaaatataacccaaatcgtctaagatagaatgaaaaattgactctcaaggaaatatttgaaggaacagaatacagcttaaaaatttgaaaatccttaaaaatatctgagaagtttttgcatccgtaaaacagaaaacagcacgaactttaggaaatgacaatgggcacagaatgcaat

SEQ ID NO: 1401 - DNA, 860 bp, Homo sapiens
ggatggcaaccttcagctagactgcctggctcaagggtggaagcaataccaacagagagcatttggctggttccggtgttcctcctgccagcgaagttgggcttccgccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcatgaggaagtctccagaaatgccagtaatcctggaagtgtccctggaaggatcccatgacacagccaattgtgaggcatgcactttgggcatatgtggacagggcttaaaaagctacatgacaaagccgtccaaatccctactcccccacctaaagactgggaattcctcacctggaattggtgctgtgtacctcgcaaaccaagccaagaaccagtcagatgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactttctcttattttaattccatggtagtcaatgaactggctgccactttaatataactgaaaattcattttgagaccaagcaggatcaagtttgtagaataaacactggtttcctagccatcctctgaaaacagtatgaaacatgaccaagtacataatggatttagtaataaatattgtcgaattgct

SEQ ID NO: 1402 - DNA, 414 bp, Homo sapiens
aacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaac

SEQ ID NO: 1403 - DNA, 596 bp, Homo sapiens
atgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatgg

SEQ ID NO: 1404 - DNA, 463 bp, Homo sapiens
ggccctggtggcctccgtggccccaagatcacaagggcgtagcgaaggcgagccggcgatcgtacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttctc

SEQ ID NO: 1405 - DNA, 901 bp, Homo sapiens
aagttcctgttagttaaagtctggtttgttccattcaaagtcaggtacagagagaggcgcgtgcgtgtgttcggaagcacaggtgaatgtaaaggtttgtttcctctcccagcacttaggcatactgcccttttctccacagtgcccctggaggacacacggaatgaagtcagcagctggcctgggcagctctgctctctgtgcttgctcacctgtgtgccccagaaagtgtctctgtgacattcctgacttcctctctgtcttttctcctttctttccattcaagaaaaccctctcttagaaacaatagtagccaacatgtgttagcacctaccatgtgctggtgttgactaaggactttatatgcattcggtcctcacaatctacaaggctctccctggagtcagcagacctggcttcagtgttcttgatgagtgagtgacttgggccagtaactcacttcccccttggaagtccagagggcaacacggcctgccctgatcttgggaggcactagaggaatgaagcagctgtgcagccaggacatgtgtgtacacagtgaggggggacacacccgtgccttcccttctcctcgggctgttttcttctctcacgtggccactgtcatcccggaactactgtggcccaactccctccctgaagccctgaacccgaagggtagggattccggagcccctgccacagagactacactacttagagagtcattccaaaagacaaaggggaacctccaaaatgccttccttttcattctgaggagtctgtcccttctgtgcatatttatagtctacacgggagtgtctgatgcaactttgaattatgcaaatgggaaatagtgcacttgtgtacaatctttatattaaaaaatgtgaaataatgc

SEQ ID NO: 1406 - DNA, 749 bp, Homo sapiens
agcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaa

SEQ ID NO: 1407 - DNA, 573 bp, Homo sapiens
atggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacattttt

SEQ ID NO: 1408 - DNA, 618 bp, Homo sapiens
ttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaa

SEQ ID NO: 1409 - DNA, 1097 bp, Homo sapiens
taagtttagggaaaaaaaattgggtttgggattttttggtttcaacatttgtgattgagagactatggacctgtaataagtccaagaacagcagttgcagtgtaacaggactgttaatggaatcgggtcatttagaaacagtcaagacttcgctgttgtgcatgtggttaggagccagtgcacacgtcagttcttaggaaatgtacagtctgagcaatagcatttgaaatccaagactcttcccattgtgttgctgttgagtgtagaaaataaaatgtgtgaatttctttatcttgagtattgagattctccccttagaataaaacaagaatttttctctcagtgtaaaaatgtcaagttttattcttgaaatgaatagcaaagttaagcttaaaaacgtgaacagcttcagaactataaatgggtatgtatacctttctgctgtctaagggcagagaagggaaagaaagtgtggtgcttatcagaggagacagcagcaagacacattgtgacagaaaaccaagggtatcctgtgtcacagtgaaatgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggttgctgttcatgtgtagcctacaacagaactataagacctatagacatttatatgaatatttatttgaaaacgtataatatcaaacaatgtaaaagccaatagaaatctcagataattgaatgtatagaaactagcagtttgaaagtgattagttcattatttgctgatcaagcagaaaaataagcatatgaaagatatttaaaatgggattaataaagttgatttaacagatcctattccatgtcctttgaatatttatagaaattaaatggaacaaattagggcatcaggaaaactatacaaaagtctttacc

SEQ ID NO: 1410 - DNA, 1071 bp, Homo sapiens
acttaaactggtcttgtagtctttattgactgtttgtaccaaattgactccaggagaaatggaaaatctaattagatctataactcttcaagacattgaaattacagctttaaattttacaataaagaatattctggccaggcatggtggctcacgcgtgtaatcccactgcactccggcctgggcaatagggcaagactccgtctcaaaaaaaccagaatattctaggctcaaatggtattacagatgagtctaccaaacattcaaggagcaattaattccaatcttaaattcttcaaataataattaaaaaaaggctgggtggtaggcacatgagtggacatattatttgttaatccttttgtgcataataaaataattttttttttttttttttgagatggagtctcactctgtcacccaggctggagtgcagtggcacaatcatagctcactgcaacctctgcctcccgggttcaagtgattctcctacctcagcctcctgagaggtagctgggagtacaggtgtgcgccaccctgcctggctattctttttgtatttttagtagagatggggtttcaccatgttggccaggctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggc

SEQ ID NO: 1411 - DNA, 689 bp, Homo sapiens
ttgaagcagaaagatggtgaatatggtataaactttgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtc

SEQ ID NO: 1412 - DNA, 1307 bp, Homo sapiens
aaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggagaatgtgaaaatggtatcataaaacaggaaatgtgcttcatatgcccaagaggggaagaggtggaatcggaactccaaaacaactggtacatgttttgttgatgggcaaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaacacctcacgtatgttattcttcatcctgttcttcccattgggactgttatggccatattctacagtatagtaaattttaaattggccacatttttttttgcttcagcaagttatgtaaaatgctataaattatgtgtatgttaaaggagtactttaagaagagatctttatccaaagttgtttttttatatttaaatgcttacctttattttttgtaaagtgcagcatactcatttgtgtataatcttactgatcagatgtttaaaattattccaaatacttcattaaaataattattttattat

SEQ ID NO: 1413 - DNA, 724 bp, Homo sapiens
gccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagacgtgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcag

SEQ ID NO: 1414 - DNA, 442 bp, Homo sapiens
attacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatg

SEQ ID NO: 1415 - DNA, 649 bp, Homo sapiens
gattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaatt

SEQ ID NO: 1416 - DNA, 1074 bp, Homo sapiens
gagaaaaaccctgtagacattagtcactcctcattctgtctcaaaccctctccctgaccctcagccctaggtagcaactacctagtgcgatcaatcccatatgcatagattaccatattgtggacatttcctataagcggaattgcacaataggggagctgttatgactgacataacacgtagcacaatattttcaagattcgtccacattgtaggcttacccacagggggaaaccattttattgggggcttttagtaacaccggtgttttctccttccttacgtccttctttccttccttctttccttccttccttccttccttcctgacttccttctttccttccctccttcctcctatttctctcttactccttctgccctctctctttcctatgccttaggtgcatccacattctgcgtttttttggggaaatcctcgacaggtgcaggaaaattgtgttattgtaacaatttaccgttatctctctttcacggctctccatcagttgtgaacatctattggtttatcccaagtcactaagcatattttcattaggtaaacctgtttttccttctacagctgtttctggagtatagggtcgcatactcataaacccagtgtaactcagaaacgcatctaatattccagtaaacccatcataacgttgaaaaatcgtaaatcaaaccatcataagtcacggtttgtccgtggatatgggcgtcatcaattccattgtattcagtaatgctgtacaccattaacaatggcagactgattgggagtggatattgatagcattataaaagtcagttattagagggatacttctttaacctgactgaagaactgatctaatggctttagtacagtgcatgattatgtgcgatgttttgagacagagtagtacatttgtgaatgaaattttatggcttttttttcacttagtaggaaccattgtgtgtggaaaagtgagaaaatggctttctgctgtagggtctggcattcattgtagatgtaagcttatttttctgtgagcaaatcttattcaataaaatactactctttatact

SEQ ID NO: 1417 - DNA, 1156 bp, Homo sapiens
taaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttggg

SEQ ID NO: 1418 - DNA, 715 bp, Homo sapiens
ttaccctacaactatgataaatatttaaactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcgtggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttccta

SEQ ID NO: 1419 - DNA, 1207 bp, Homo sapiens
aaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttccttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaaga

SEQ ID NO: 1420 - DNA, 488 bp, Homo sapiens
aaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaaattctcttttggctctaagaagtcagctgtatgagcaggcgtgaccatatcataacatgctgatatgatagaaatcaataaatttttacctctcagg

SEQ ID NO: 1421 - DNA, 513 bp, Homo sapiens
aattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccata

SEQ ID NO: 1422 - DNA, 831 bp, Homo sapiens
ggcaaaattacgatgtttttctcatttctggtgattggcttccgagtgttatttagagagcggagtgcagagggctctttgcagccctgcggtagtgtcttgtgctcaccaagaggctcacgggaaacatgtcctccaacatgaaggtgtttgctaagattccaaccaggacccagtcttgggccacagaacactgactgctcccccaagcccctcgcagaccgcaggagtattttcccttcagaacctgttgcatcagaatggggaaagcgagggctgagaatcccagaggaggccgtgaactgttctggaaaagcgagggctttgcagtcagaccttcatatgcactttgttctatctgttgcgctctgcctaaatgaccacgggccagtgactttacctctctgatccctgctccttgcctagatagtggggatcacgtcgtaatgtatgtaaagaaccgggtgcgggacttggcacctgggaagtgtcttaatacatgtctgtcgagaaaaggaagggtctcgacgtgcggaaacaagacggatgccaggaaatacgtctgcccacctccacgcccctgacagcggaggctcctggaggtctggtgagaggccccacgtgctccagccccctccgctctgtgctgagctctgcctttaagagactgcagctcctgcctctaaaaagcctttcaaaattctttattaaattttcatggcgcataaagtcaaggttctgttacttggcctcagttgtcttggcaacttcataaaacgcaataataaaacgaagctgagtgttgctaaacacaggctcattgtataaacg

SEQ ID NO: 1423 - DNA, 550 bp, Homo sapiens
agatttttaactacccaattctgctgggggtgggggacacccccttcctcgctgggtgctggaccccttttgcagcctgggctctgcttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagatcctggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattc

SEQ ID NO: 1424 - DNA, 569 bp, Homo sapiens
taacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcct

SEQ ID NO: 1425 - DNA, 723 bp, Homo sapiens
ggtttagaaagttcaaaatattggaagtgctagaaggctgcaacttgtaaaattgtactccccaagttcagtaggatagtagagaagtcgtgctaagttgatttcattgaaatgtcacgtctcacatcctgtggtccaaaggtactagtttgttttgtggaataattttctgttcacttgctgataagaaatttagcagtcagaagtaatttttaattaataacctttctttttaaaagttgctttatggtttacaagtaatactgatgcaaaaaggatttgttaacctaaattaagtagcacgcactttgtttacatgcttcagtatattgtggggttggtcccttctcacaaacccaggacctgtgcttggggaacattttgccatcatgctgttctcttgtaccaaggatcagtgaaagtgttttatcttttttatgtagtttgtattgactggattttataactgtaagaaaacagaaacagagtgttgtattttgatctgaaatttgtgtatgctaaagtaattttgttttatgtattggaagttcacttaaaaacttgaaatattttctagaagggtaccacacaaaaggaatcatctttaagctgtttaattaacctaataaaataatttgatggggaaggcattctaattgtttctgatttttagagtggttcctgctaaatcatcattatcaatacagcttgatttgatttaag

SEQ ID NO: 1426 - DNA, 706 bp, Homo sapiens
accggcgcgccagggctgtccgtcgcgtcggcggcgcaagtggaattgggatgcattcgagtctgtaacttctgaaacctgaacaacctcaggaggcccccacctctgccctccaccagcgtcgagagaagggacagcagtgacatcggacagaagacccgggctcccgtcctcccccaggacggtccccacataggaagggcactcccagccctcttgctggtgacattgtcatggtcatcttgtttctgtttggatttttcttctgggtcttatgtttggggggaggtttattctttctgaaaatgtctagattcaggaacacatttatgaggatttggattttgaatttgtatttccctctaagtgccttttttaatgtctatttttttaataaaacagaaatgcattcttgtacaattctgttgaaactggaccaaggctctcagaagaggacccccgagttccttcccctcccccgagcctctgcatgattgtttcaagtcagcctggaattcttactttcacgccgctattcttttcctttctccgtgattgcttggctagccattttaaaaaaaatattctctgttcagtgtatatgttgcttgtttgttttatttattgagatatttttacaagctaagtgactgcagtgtggctgtgtatcctgctccccacccaggaaaaataaagacgtccgcgc

SEQ ID NO: 1427 - DNA, 527 bp, Homo sapiens
tgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccac

SEQ ID NO: 1428 - DNA, 520 bp, Homo sapiens
gccacctgccctgcctccctcctccccgttggcccctgtttggacttagtgcctgtctggcagcctgtggggtcaggagaagcacccccagggcagcccttttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgt

SEQ ID NO: 1429 - DNA, 459 bp, Homo sapiens
ggagaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 1430 - DNA, 1284 bp, Homo sapiens
gcccattcttcacgcagtgtccacgtgcgtctgtctcgtggatgcaggttcctgttttgtagtaacgcaggtggtacttgcgttctgtgtcccccgtcgtccggtgcaggtagggacacagaatgcacagtggagacccagctaggcacaccccggacccatccagacaggagttctgcacctgccggacgacagaggcctgtggaggcgcacagggcaagcgggaagtgtcaggtctgtcaggtgacaccgccaaacagagctctgtgtctgtgtgtcaatctggaaaagtggcaccacaggaatggggcaagcctgttttttctgagaacgagacccagggtggctgcagggccacagtgcaggagcgctcttctggacaggggtgggctggcagatggccactcgttctgtggctacacagctgcaggccacgtgtatttttttttcccaatgaaaatgggcctagaggctgggcatggtgcctcaggcctgtaatctcaggactctgggaagcctagcgatatggatcgcttgggtactccggagctcgaggcaggagaatcgcttgaacccaggaggcagaggttgcagtgagccaagattgcgccactgcactccagcctaggtgacagtgcgagactctgtctcaaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagactta

SEQ ID NO: 1431 - DNA, 1733 bp, Homo sapiens
tttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgccctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagtaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttaattatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaagtcctttttccaattctgtacattaaatatatgtgttttaaagg

SEQ ID NO: 1432 - DNA, 994 bp, Homo sapiens
cattggtagagcaaattccagtggtggtaaatcaagaactctaaagttcagtagagacaggtgttttgaatgtcaaggaaatcactgaggtagatttgggattacaataagacagctgccctgtgaggtcataagagcttttgtgaggcttactccaggggttctcagtcttggcattactgacattttgaattggatgtgttcttgctcctgatgtgtgggttgtgtactgtaggatgtttagctgcacccctgaccgctatgcataaatgccggtactgtcccccgaagttgtgacaaccaatgtctccagacattgccacatataacctgggaaaaaaaattgccccaagttctgagccactgggtagaactaagggtagtttagggacaatgttaatgaaagcctctccaaagtcccatagtctttttaataattaattctgcagaatttgctctttaaaaacatatttttaaaggcaagaccagcctattcataaaaattgcagttgtttccacataagaactttggatatttaaagaaaaatgtaatttgaaatgaaaagcccttataaatccctttatactcatcagtcattataacagtaaatgaaatgaagaaaaagcatttggtctcactcttctgtgctgatctctttaactcctgaatatcctcaatttgatgagcccactatccaatgagactggatagttatcagcacaattgattcatggggttgagatgtttaaatctccttcatatttaaaatgatcgattttaaacttgatgatgttaattcttcttagttcctggtaagcagctcatcttagtgctaatgacaagttcagatgttaaaaaaatctttatcatttatggctaattttatcctttgccaaatcatatctattttcttcaagagagcaaaatacatttcctgattttaaagtattctatttttaaatatatcttcacattcctgtagtaaaagactgc

SEQ ID NO: 1433 - DNA, 572 bp, Homo sapiens
gcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccc

SEQ ID NO: 1434 - DNA, 503 bp, Homo sapiens
atccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacg

SEQ ID NO: 1435 - DNA, 1140 bp, Homo sapiens
gttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcgtaactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgccaagtgcctgcaactcacgtcaatcatagaattgtgacgcacagttggcaaaatagttctttatgctatttctcaaaattttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaacttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctc

SEQ ID NO: 1436 - DNA, 842 bp, Homo sapiens
agatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttag

SEQ ID NO: 1437 - DNA, 546 bp, Homo sapiens
taaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcgtatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcag

SEQ ID NO: 1438 - DNA, 1023 bp, Homo sapiens
ttttcatggaagaatcttcaggtcaccaaagaattgaaattttaagccccagattgtactgagctgtacctgtgggaaaaggaatggccagggtattgatgatggaaaagattcaaatgaggagttagaaggcaagccctctgtgggcagccgtcttccagaaacctcgaacttatgtctgtctccacctgagaaaggagaagaaaagctggtggtgacccctgctcctgctgggccatgccatggctctgaagatgccccgtgttcttaggaggtgctcacccctggcacctaaagacatttccttctggttgttgctctttaaaaacaaaataagcccctgaacgtgcttgcaggccagtttgtgtgcctgcacttgacgaattaccttgaccaacgggccaaaggcacagagctccaaggcatcatctttccttaaaatcctgagtgtttattaaaaagggacatggtctctaggtatcttattacatttgtatttcttacatttgaaatatcctaaccgctcccttcggtttcttcttaagaacatttacatctaattatttttcgtgcaagtcttgtaggacccacatgttttcctagctttggaaatcgatttttttcattcctcttatgaggatttccctatgtcagtaaacattaactttctatttcttccatttttgctcatttgaaacccctgctgcttctagatctatttctttgcacttgtataactttgaaataaattcctcatcccttagactaagagagtgggtgtctgtgaaaattgttttctccttcataatacctaaattctagtttgtcagtaaaatatttgtgtttggttaacaagctcttatttaagccattgagttagtataatctttattacctttgaaaaaccagagagctgaattttttgtcattctaagttgtaagtaacactgcagtcaagtcttctgatgaaatttccatatatcaaattgaaaataaagcaaaatatatttattactcataact

SEQ ID NO: 1439 - DNA, 1293 bp, Homo sapiens
cggacaaggccaggcctagccttgagctccgtcgggcagggcgccgggattggtgtccggcagagcgtgagccagcggtgggagtcggcgagcgggagtgaaagaagaaaagctagagagcgaaggcaaagccgaggagagagggccgcggtcggcggaggaatctgactgcacggttgcgtcgctcacttccggaggctccctcaggcgggcggctccctagtggctaaaggcaaagcattccggggcgcggcgcatgaagttgagcttcgtccctgctagccgccgctttctccccaaaaatacatcctagccttaatgtttatgcctccattgccccagttcttatctgttttgctcaatgtctcatagctacaagaaggcaatttctgacgaagctctccgtcccttccaaatggattattttggcgggcttacacccggacagtatgccacccgaatgactggacaagtgcacgggagcggctgtcatttgcggagtgcgccttgcgatctaggcgcctcacagcgcaaattatccagtaatttctctgaaatcgatgctggtttgttttcccaaggcaaatcagcagcttatacagacattggggccacaaagccggtggaacaacgggagacggcttcctgagtgtcaggtcctccaagatgagcttaaacttcgggtggtgggcaggctcggtaggcgggaaaggcccgtgtccagatgaatgcagtccatgtttatattgatgaaagacacgtataccatttggtccagctcaaccattcttaacaagtgctggctgtgagcactggtgtgtgtgtgcctgcgtgcaaccagcaatgtaagtgatgaccagctgcatgatgccttaatttgagtggacaaagtcggtcaagaaccactttcaggcttctgggtctccaagtctttgtctccctgtatccaaacgaggcattccaagtttgacagcatggaacattgcatgtccgaaataccaaccgtgaaactgggtaaaaagcttcaggaggtgatattgatgtgtatagtttaggaaataaaacccaatacttacttcaaagaatgtaatttgtggctttttagagagaaggatactttgacagttttcatttgtcgtctacatgtatatggtacgtttcattctgccttttaattaatttggtattttactatgaaaactactttgtattaataaaataatgtatttccaatgttataagttgtgttataacagtttcaaaaaccaaataaacaagatgcattttgatatc

SEQ ID NO: 1440 - DNA, 430 bp, Homo sapiens
cgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgc

SEQ ID NO: 1441 - DNA, 1123 bp, Homo sapiens
ccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcag

SEQ ID NO: 1442 - DNA, 564 bp, Homo sapiens
tattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaag

SEQ ID NO: 1443 - DNA, 450 bp, Homo sapiens
aagcacctttaatcatttttgttgttttaagataatgtatttgtgaagtggataaacactggaaatagggtgcttcttctggaaagttcagtgtaaaacacaaacaaggctttggcgggtttatctggctttataaacaagtctgaaaaatggatgaaagctaaatatataaagcagttggttgtctatcttttatcatttttactcagatctgtatttaacacttatttatttgttagtttttacattcaaaagaaatacactttgaactttggctaacattgtaggatattttttaattgtttctacatttttaaagcatgattcatcatttttgtaaacttagatcattttttaattgtcttttcttttccaatagaccagttaccactcatgtgtctgcagaacctctttattgtattcctataataaatgtaaaatatttgtagc

SEQ ID NO: 1444 - DNA, 958 bp, Homo sapiens
ctgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagcc

SEQ ID NO: 1445 - DNA, 839 bp, Homo sapiens
taattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttggacttttgagatatttgtattactccacttaaataatgaaatcagatatctcctttcctctgaattgtagttgaagcagcattcatatcagtgaaggacttaaatttatcctgaagggatgattatgttgggataaagctaagtatcatatttgaattagctgt

SEQ ID NO: 1446 - DNA, 862 bp, Homo sapiens
aatttataattactattattgttttgtagggacagagttttgctatgttgcccagattggtctcaaactcctggcctctcactcctgccgtcatggcctccaaagtttaatttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagtgctttgaattttaaaacattaaacaaatccttaaataac

SEQ ID NO: 1447 - DNA, 664 bp, Homo sapiens
ccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactggg

SEQ ID NO: 1448 - DNA, 691 bp, Homo sapiens
ctaaatggaaggaattggaactgaaagggaaaggaaatggaaggaaggggaatttggaggagagaacacgcccacccttgggaagctgcctgtccccagaggagccccaccagggagcagctgccccctcatcagagacctgcagagtcaaccaagcacaggttagagtcccaggaccggaaaccaactgtgggctttctgtacttctcatagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacacaactaacagagcatggtgaatacatgctgaattgcattcagtatggctgtgaactaggcctggggacaagaatgaattttacatggaaagaatttcctgtagcaggaacagaggggataacaacagcaataaataataataagaagaagct

SEQ ID NO: 1449 - DNA, 787 bp, Homo sapiens
gcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactgg

SEQ ID NO: 1450 - DNA, 510 bp, Homo sapiens
atactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggc

SEQ ID NO: 1451 - DNA, 517 bp, Homo sapiens
gaggagctgcagatgatgagggacctacccaacaagaaccaacctgagcagctgcttcaagaaaaagccatgttcaaggtgcctgaatcccctggtaagtgagtgacagcctcacagcctcaggcccacctggctcctgctggaaggttttcttgtgctcgggagagaagtgagggaagccggcagtcccagccctgtcaggtgccctgaaggcccgtcaggtttgccctgcaaggccttctagcattctgcttcctgggagaccatcccccacctttctccggcctctgagactttgagtccttgggaggagaaggccctccttgctatctgggctgagtggccagggccatccagcttcccaccctccactgactgccatggggccctcccctgagcacatggtgcccaactgtagcccttctagggcaggggctcattggcagcacttgcagcttgctggcacttaaaagtcattagtgcggttactgagagaaatgaggaaaaaataattgtt

SEQ ID NO: 1452 - DNA, 468 bp, Homo sapiens
aagattagttgaacttccctcaactacacctaaagcaaaggggaattttagtaagtgtgtgtaccttgtttctttcagacgcatctagaatgtttttctttccccgtacctccaaaagaggcaatttagaaagtattaagtagtgacttttgttcagttccattttgtgtgtgtgtgtgtgtgtgtgttaaccttgctttaaaacagtagcatatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgtt

SEQ ID NO: 1453 - DNA, 848 bp, Homo sapiens
ggaaatgagatcaacctgtagtagggtgggccctaaattcaatgactagctcttagaaaagaaggggaaatagacacacagagctgaaggccatgggaagatggaggcagagattagagcaatgcatctatgagccaaagaaccctaagaattggaggaagtcactagaagctaggaaaacaggcatgtcacagattctccctcagagtctcgagaaggaaccaaccctaccaatatcttgatttcagacatctggcctccaggattgtgagggaataaatttctgttgttttaagccatgcagtttgtggtattttggtacagcagccttaagaatctgatacatgtatctcgtaaaacacctctgatacttacctgcgcttgtggctgtgttttctgatactatgagagccgtagtatctggataccggagagtctgcgaacttgagagaagggccgtgtctgattttccttcagtgtcccaaggaaggatcttgcacagtacccagatttggagaggtgccaagtgaatgcttcggtggactgaatgaatacaaatcaaaaataatgatgcagcgggaatggatgcagtaagattgctgtggcctatgcagttcacacagttcacactctgcatgttgaggagtaagtggacagatctcttaagcccaggggctagcaaaccggtctgtgggccaatttactcaccgtctgtttttgtacagcttgtgagctaaaaatggtttttaaaaaggttgaatacaatcaaaagaataatattttgtggcatgagaaaagcatatgaaattcaaattttagtgttcataaataaaattttattggaacct

SEQ ID NO: 1454 - DNA, 1044 bp, Homo sapiens
gctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattac

SEQ ID NO: 1455 - DNA, 988 bp, Homo sapiens
acagctggtttgagcaactgaactggaaacaagatgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaatttggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatgagttggaatggaaactgtctgaatctggagcaattatgacagacctggaggaaaaccctaagaagccgattgaagacgtgttgctgtcctcagtgcggcgctctgtcctcatgaagagggacagcgattccgagggtgactgaggctacagcttctatcacatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactcttttttttttaaattatagtatttcctctaaaaaaaattaaaaccagccatttgtatggc

SEQ ID NO: 1456 - DNA, 1123 bp, Homo sapiens
gtaatttaaaatgtttttgcccaaagtcttggaaatccaatgtgtattttacacttagaacatgccggtcagacgagttaaattttgggtgcttgatagccacatgtagtgaatggctcccatagtagacagtgcaggttctgcctgaatatcagactgcttagtagtcattgctaagttcttcgtgccactccaagccttccgtccacacagctttatttggacccaatgtgtaacctagccaccagagcccatgtgcgcactagcttttatatttcaagctgtgttttagtcctagatcaggtagctaatttctggatgaagataggtaaatgcctagaatttacatcattaaattagttggagtaaatgtgttcaaatacatggacctgatgaatcaatggccctgttgccaagtaaaacctccattgcatttaacagtggaaagaaaatctgtcatagtgcttcccacagtctgtttgagaataagaaccaaccacttctaatatttgacacactgcacatctttttagtgtctgttgattcagacaatacacagtgagaaaagacttccattttagtaaacttattaatcataatagcatctgtatatatttgatatattatgtgataatatgtaatatctatttgataaatcatagttatttaataatgatgatattacatattaaatcactgtactggcaatacataatgtacacatagcttgccgagctctatattatgatgccaggtaacccacagtgtggactccactgtatatatgaacatcacatgcataaatgttaagcacagatagcacatatggaaaaatttgaaatgagctaaggttaaagaagatgctaaagagcaggtaccaagaaatctcagaaagcggactgaagtgttaaataaagaatgtttggcttgggaagcaatctgggcttaaattgaatgcattttatttagtgactggaaatttttgaagttcaaaaattttttaaaaacagttatgttagaatagactctgtatctgaattcttgatactaatgaccttataacaagttgggtttgatcccattcacttgagccagttggttttttgtaagtgaatttctcatt

SEQ ID NO: 1457 - DNA, 970 bp, Homo sapiens
aaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatc

SEQ ID NO: 1458 - DNA, 980 bp, Homo sapiens
gtttaatgtttattcttattacttatgtctttcacaatagagctacccagagcactggctactgttagaacaagatatatagcatatatttcaatagaacgcccagataataaaaaatctgaatctggatgtatctatatcctattggcttgttataggttatcagagcactggatactgttagtacaagatatatagcatatatttcaatagaacgcccagataataaaaaatctgaatctggatgtatctatatcctattggcttgttataggttatcctttattttattccagagggaaataactttaggtataattctaagaactgcataataacttgaatactttttctctgacaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaa

SEQ ID NO: 1459 - DNA, 665 bp, Homo sapiens
ggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgccaacctggagggtcccctcttatcccttcaagccaagcttcctgctcaggattagtttccagctaagtctgcaagccctagaggagtttttccaggctgtctgtgaagcctggggaacacaacggcaactgggagatttgtgagtgaacactgtttcatcttaatatgcttctgaatttattttcatgtactaaatagatcagctcatcaaagcc

SEQ ID NO: 1460 - DNA, 665 bp, Homo sapiens
taaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaatg

SEQ ID NO: 1461 - DNA, 486 bp, Homo sapiens
gttctatagggattatgcccttttataatacataatataccacagagattacaaatgttgaggaatgaaagcacttctttgctttggcaatcattttcagaccactatgtgtttgaatcctctggtatcaatacgtattatagggttttagagatctgtgggtcaaatgatgtccctcaaaacttcctaaaaaggtgaagctcaaagtcacacattcatttataaggcgcatgagtttctcattttcccatgtacgagcattgtaaaggaattcagctgtattaatttctatttcagatctagaattgacattttgccttcttgtttccaggtgtttctattttttgtattctttcagagaaatctcatatttcggtgtatttattgctgttactactatatttactgctgaaaactgtaacaacctgaagatttgtaaaatgttaaacatagttcattaaaaataataaaataaatctaaaatgt

SEQ ID NO: 1462 - DNA, 597 bp, Homo sapiens
attttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 1463 - DNA, 575 bp, Homo sapiens
caaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatcagaggggtcctgtggcagtgctttcagttgtggggggtggaggtaggtttttgcttagcaggggccaggtatggtgc

SEQ ID NO: 1464 - DNA, 708 bp, Homo sapiens
tataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaagaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtgaccttgtgtacttttgaaataaaatcaagaaagcagt

SEQ ID NO: 1465 - DNA, 478 bp, Homo sapiens
tttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 1466 - DNA, 1210 bp, Homo sapiens
gcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggtttactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaa

SEQ ID NO: 1467 - DNA, 933 bp, Homo sapiens
cagtgttttatgcacctgctatgctctgggcataagctgtgcctatgtatagtgtatatttctttttttcttttttttaaggtctatgggttttgttttttacatgcaaacattgtaaattatacagaagataccacagatagcatttataaagtatacagaaacattatctgaaagcaaagtatgatagtttgttttgctatacagtacatctatattgatagaggttcatgtttaaattatacatatttattagcatcatattgtcatttgttttgagcagtctgaataaacgagaccgggaaagacatccctggcaggcatcagaactattttgcacatgatttttaaaggtatttattagaaatcaaagaacactcaaaataaactcagtgctcaaagggttaagtctatttgaaaaggttaaaaaaaagaacaacaaaaaaaaaagaacttgtactgtatttcctaaacattgataaagcctttaaaatgtttgtactgtaatactttgcttaaaagtcatgaggcattctgtgatccaacctctttcacttatttataagccctcttggttgctattccatattgtaggatgcctttctatttcaattggtaactttctgttttgttcttcctaattattctcccaagatcccacactgcagctttatctttaggcttatgaaaggtaacccgtggttaccggctctccaagtgattctgttcttctccatttttggcagttaatttgcagaagtaactgacagctgacaccatatgagaacctttgtataaaatattggcatgtaaacagcacagacaccgtaacacactctgtgccctgtttggttgttgacaatgaagcaccattatgtgactcttcatataacccttttttctacggcagcattaaaattgtctttttgctat

SEQ ID NO: 1468 - DNA, 783 bp, Homo sapiens
ctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgaagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaggcattccttactggcttgctaccagcaattgaactgtattctttatatagctagagctgtttgtgtcttcttaaaataaactttttctgttaaaatcat

SEQ ID NO: 1469 - DNA, 729 bp, Homo sapiens
ccctgcactctgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcgg

SEQ ID NO: 1470 - DNA, 770 bp, Homo sapiens
gttttatgttttacttcaatcttttcatcggctttattttgatagtttgttttatagaggaggaaacagacttaggtaagttacaagatgacaaggttactaccttgttcagttagtagtcagcagctagtatatccaaagatagtacgagtcagaactaggattataaactcagggctacctgaaactcacaacttcaggcatctttgatttcttcttttcacccacagccaattcttcaactaaattgtatccattctgttttcaccgtctcttgtactggtctcctttctattgtaactgtcatcatcctaactcaagatccttctgtagctttccccggttattggaatatccttattacgactgccaccttttctaatccagtctgtttactactgccgggttaatttccccaaactgcatgtctggggaataaccttgtggttatgacagaattcccaaaggaaagcaaacttggcaaggtgcaaagactatgaagacttagaacttaagagttctatggagatcttcagaaatataaattagctactcaacatatctgttattctgccctgattgcactgtaaagcaaaaggagagaggccattatggggaaaaagatccaaaaggactcatctaaaacacaagttgggtagaggagataggtgagtactattatattatgttcatggaaaatgagttcatgggctttcctctaatttttattttaaaaataaatgtaaatattaaataaaattttttaaatg

SEQ ID NO: 1471 - DNA, 899 bp, Homo sapiens
gcgaagtggcgcacaagagcatcgaggcagtggtggctcggctagagaagcagaacggcctgagcctgggccatagcacgtgtccggaagaggtcttcgtggaggcctcgcaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgcggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcat

SEQ ID NO: 1472 - DNA, 1177 bp, Homo sapiens
ctacttatgttttccattacctgtgacaggaagcacacggaatgaaagcagaccacggaagggttaacaacccctcaacctaacttatgtgtaccttgtaaagctaaacaaataaaccaaacacaaacagtcaatgcaaagacttcaattcaaagtaacctttgggctaaatatattaaaactttccagtcattaatctatacttctatcctttcctgaaagtaaaggccttgccattacttctctcattattaaatagtaggacacaataaacctggatattgactgaagtttatattttacatttcaaacgtgaaaattcagaactgcccatttccaattttacagtgggatcctgacaggttttaaaagtgacagtgctgaggcatgatattcattaacactggttttctgttgagaacatatacaccaaaaccaaattgctctgagatgtctcctattttctttctaggaaatttctaggcttttaagtttaaaaaataaatgattatgatgtaattattactttccagagtgttttgcaataacttcaacctgttaagagatacaaagaactatattaaactgggaactacaataacgtacacagaaccctcttcaaagaaattaaatatattagatgttaaaatgtggtagaaagatgcagctttcccaaagtagtaaagtactgcacatatgggttttgtggcagtccttggaaatatcctaggtagaacttaatgtagaaataaaaaggctaccacatattttcaatccaagtcatttttacaagaaaaaaaaaagtgacacaaaataatgcactttaagttggtagcatacacaaggttattttttagcctaacatagacaggccaaatcattgaaataaaaaaaatatagaaaaacataaaagcccattaacttctgaattttgggaaagaaacaagaaagagcccaaagttttcagataggcacacataatttagattagaaatgaaaatgggctttaagccctataaatattgttttccaagaaaataagttttgaaagtgcaaaatgacaactcaaaaaggtcccctttccacctcatgcaggcaaaggacatttaaaagcacatccaactaaatcaaaaaagggaggattagaaatcacactagttcatccttcattatcagg

SEQ ID NO: 1473 - DNA, 991 bp, Homo sapiens
aatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatatttt

SEQ ID NO: 1474 - DNA, 474 bp, Homo sapiens
agtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtatttttaa

SEQ ID NO: 1475 - DNA, 1073 bp, Homo sapiens
acgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtcccaagcctggcagaatgagaggggttgaggtcccgagcgccactcctagccttgccgccttcaatagagaagaaatccctttgctagatagggtccccaggcagtccccagtggcgggacacaggggtccggctgtggagctcccctgccagcccctggagctccaggagggcctgttggtccctgttcagaatggagtgcagccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaactatcagcagctg

SEQ ID NO: 1476 - DNA, 718 bp, Homo sapiens
taaagtggtctttttttttttacttatttgtttcacctcttgtttgagtaacttctaaggtgctattctctctctctttttgctaccccatgagctcttgtcacagccatggaaaccagcctcgtttagaaagggaacttagttcagaaggggttaaaagccttccagaatttttctttagctgctgaagtttttacatgtggttacatgactttaagttttatgcattacgctcttaattctattacaaaatgtggactcaccaattgctttgtgttttccatgtgacctgttacttcaggctacttggggaacatcttagtcctctgtagctcctgaacccagcactggtgcttcaagagagaaggtagcacgtctttgttcaaaacaaaacaaaacgacacttctggaggccacatcctgaatatgaatgttctactaagtcactcagttatggttctaaagggaaactgtaagaagacccacaaggagtggaccaagactattatttaattgcacaacttgaaactttgctgccagaagaggcagctccattcctttgactccagtgttgggctgttaactgctgcacctcattgcctttttttgtttttgtttttgttttgtaggagggtaggcactgttgggccatatgcacaaatattgtaactcttggtatctttactgcatcatagtcaataaacttctttgtaccctt

SEQ ID NO: 1477 - DNA, 438 bp, Homo sapiens
cgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 1478 - DNA, 960 bp, Homo sapiens
gctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagctagtccctccccacctgcccagagctccaggccagcacagaaattcctgatgccaacgtcgaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttgggg

SEQ ID NO: 1479 - DNA, 1271 bp, Homo sapiens
ccctgagattcaagtagtacattatttcatttactattttacacagagaagccctcatttttaagagtttgcctttctgatttccaccggaaatgatactatcagtatcatactcagaatcttaattacatacaaggcactaacctctcacctgttttcagctttgtgtaaagacaagggatcaaaacatccctttctgctatttcatacttaagtgtgggagctgatccaaaggaagaatagtttcaaaagtttgtagcaaaaaaaatttaaaaggtgaagattttttccttgaatgattctcacctggcagatctatggaaagattagctgactctttggatccctgaatatagttaatagaaatttggaaggaccatgtcaaaattaactaatgtgaactgacaaagatttggtgttcaaagcaaaaattaaactttggaaaagtgagcaagtacttaatcagaaacaaaaaaaaaaaagaaaggaaaagttaggtgaaaatggtttccaggtgttgttgctgttatagtttgaatcataaaagttgttaaaagtctgctgtaacaaaccatcatagactgggtgacttataaagaacaaaaatgtatttctcacagtcccagcctctgggaagtctaagatcaaggcatcagcagattcagtgtctggtgagggcccactttctggttcatagatggcaccttctcactgtctccccacgtgatggaaggggcaagaggtctctcttggtactcttttattaagggcactaatcccatccatggggctccaccttcatgacctattcatctcccagaggccctacctgcagataccatcgtatgggggatttgatttcagcctgtgaatttgggggaagcgggacaaacattcgttttgtagcaaaaggagtagagtaatatctgccaataactggaggaaagaattgttcttttaaaactattaaattgtttaatgggatttaaatgatttcaggaatgaaatggaaatcctggtaatgggtagaaacataggtaaattctccttttccacttaccaccacctgtgtgaacaacaatcatttctcattaatagtcaagaatttgaagagatcatgagtaaaaagtcttgatcagaaattgtgtatagctgtttccagcataaaaccttatataaaatgcatattcatagaagatgctcaagtatgtcatgaaaaatatgaagtttatttaaatatttatacaaattaaagatttactgtattctct

SEQ ID NO: 1480 - DNA, 786 bp, Homo sapiens
tggacgctgacaacaactgcctaggcactgaggtagcttaaactctaggcacaggccggggctgcggtgcagcacctggccatgctggctgggcggcccaagcacagcctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtcttccctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctta

SEQ ID NO: 1481 - DNA, 465 bp, Homo sapiens
tgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttggaaaaaaaaa

SEQ ID NO: 1482 - DNA, 557 bp, Homo sapiens
ctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttcctt

SEQ ID NO: 1483 - DNA, 1160 bp, Homo sapiens
aaatcaagacggtaaatcctctgggggtctatgaagaaagaggaccagagaaagccagtctatgtttatttcaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttatttttatatgtgtctttggcttttactatgggtaaaagtattttcctcgtggaaaataaggcaatgaatatgacaatcaagtggactacaagtggaagacctggccatggggatatgtttggagtgatagaatcatggggggcagcagctctacttcttctaaccggaagggtaagagatactggtaaaagcagcagcagcactggacacagggcat

SEQ ID NO: 1484 - DNA, 844 bp, Homo sapiens
agaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttacca

SEQ ID NO: 1485 - DNA, 375 bp, Homo sapiens
catgctgagacaaagcagctaacagaaatgccacccagtgtcttaaaccagcttggtgtcaacaagcttaaggaaactggcagaagctggatggaaaagtaccacttactattggggaagtggtgatcttgttcagaattttgatgaagcttccaacagtgaggcaaactgaattgattcagcttctaaaaaataatacaatttcaagaattttaactgcttttaaaatttttgttttatatatgataaaatgtaagtctataaattccaagacccttggacactgctttttaattattgattatatacagttatttattggcaattaattagccagaaaatagtttaaaacaaagataaagcctttgcctagtt

SEQ ID NO: 1486 - DNA, 763 bp, Homo sapiens
aagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggt

SEQ ID NO: 1487 - DNA, 1478 bp, Homo sapiens
ataattttgcttatatgctaactcttttcatgttagcaaagaatattctatgaattagaatgttactgtggtagatctaaaggagaatgaacagaaggtgctggaggacctgttaaacaatctctggctattaaaaaacatcaagatgagaattaaaggcatatcctgatatacttgcctgcttgcacatgaggctgggagatcccatgcctgttgaagttaactctagccctgacctctattgatcttttgggaatgagggctgatttgaaggtgctgttgcaggatttcatttagctgctgccagttcaagtgacctgtccccagggctgcagctgtatccacctgattgcagtaggtgagggctaacagcagaatttaaagtggaccctgggctgtggagcaaagtgactatccatttggacttttggataatgtggcaggagtcccagctgtttaatttctagtcacattttccagaaagttgttctaagttgagattactgacaagatttctcaagggcaggaccagatatgtgagagacttctagttcagagctgacccctctaagcctctgacacttaaacacgagtcctgctgtccccagcacacaactgcactgaagccttgttcctctcggctggtgtagagctcatctgcatgttgtgtgcagataccagtagcctccctgcttgaacaggcctctcctaggctaggcaggtgttcagaggcatgaaggtctgggcaggggaagggcgtcttctgaaatgggagttaccaggtttttaaatgctgctattgttttatttaccatttaaggtcttttctattatatctgagtaactagtcagtttttcttacagtgctcatagcagttgtatttgaattgtattttcagtgaaatttgttttacattgccatttaaaattggcctttaacagcttcccaactggcttataagatatttttttttaatgaaaacataacccatgaggctcagatgctgttgaagaaataaatggtatgttgctgctgacagtagtgcttgcctattgtaacagcattggttctgctgtagcctcggtgaccatttaagttgaataaatctgtcattttcacccacaaacagttgttgagcccctggatttgggttgtcactgtggttctcctgccagtgctataatccagtgtcgtaggtgcagggtatgaatcagctcagcctcttaggagagaggggctctcagcgaggagggggcggggggggggtcactatttatcttccagaggcagggttcatggattcctgatgtttagaggcggaagggaccttaggtcacctacttccacggttttcatactgttctctggggcctcgtggagagggagcctccaggcccattcaaagctttattagatttaaaagtaagatctggtatgaagaaaggttttgtttgtttcttaaaataaaaagtctgaa

SEQ ID NO: 1488 - DNA, 662 bp, Homo sapiens
tagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagaacatctcattcatttcttagatttgtgttcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgacct

SEQ ID NO: 1489 - DNA, 612 bp, Homo sapiens
gatgggtacaggtataatgttaatcaacttggtgatgcccatgactggaaccagaacagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatactggttgtgaatattaaaagtttttctcattgatattgctctacaagaaacctacttaatacattttttagcggacatgggtcaatttctgtttatcattaataggggttcttaacctgggctacacttttgaatttcttggggacttt

SEQ ID NO: 1490 - DNA, 510 bp, Homo sapiens
cggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattg

SEQ ID NO: 1491 - DNA, 813 bp, Homo sapiens
caaatccaaaattgccgtggatgaactctttacttcacttcgggatattgctggagctcggagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctctttgtgatcttcctgattccacctacaagttcattagttctaaataaaagcctgttggcaagtgttggta

SEQ ID NO: 1492 - DNA, 601 bp, Homo sapiens
tggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatt

SEQ ID NO: 1493 - DNA, 662 bp, Homo sapiens
tttgagctgagaatctaatagattgtctttaaattcttcagctaccttttattcagcaggaagatggacaattaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaagaaagagccttccattgttagtctaatttattttaacttgatagaaaatgagctttgtgtttgtccctcctaaacaaaaaaataaaaatcctctgtctcattgtttagtattcagcttgcataacaaaatgtatttatagtttcagtgtgtgatggttgataaaatactcagaaatgtt

SEQ ID NO: 1494 - DNA, 566 bp, Homo sapiens
cgacagggttccaggacctggaacactttaacagaaggaaatgccgaagcagcttgcacagttgctttacagacttccaagaggctgattctggcttcaagatggagccttggagttggtttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgattt

SEQ ID NO: 1495 - DNA, 702 bp, Homo sapiens
gatctcgcttttgtttttgatatacataagataccactttataaagaagctccatactatagaacctcccctaacaggcttaaaataccttctttttttttttttttttttttgagaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtt

SEQ ID NO: 1496 - DNA, 521 bp, Homo sapiens
atatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtggtgttaataaaacagtattttc

SEQ ID NO: 1497 - DNA, 1044 bp, Homo sapiens
ccagaactgaaatttaaacatatatatatatgaggatgtatatatggcatcatcagcttatttagaactgatggccataccttacaatcttgttttacccaaaattaagctattggggttgaaagctaaaaggagcacttttgtagaatagcaacttttcttttcctctttcttgattgtatggtggggtggtgacctatttttacaaattatacctaatgagtaaaattagtgtaaagtgataacatgcttctacctgtatttctagtgaccctttagcggcaggtatttatacctggtatttatgatgcagtatataagtggtgaacaataactgacagtattgtgcttgctgtacatgtctggtcttttgaaacagattttagtaagcattttccagaggtaaaactgtgtccttattctaattttattcctagggcaaagtagacagggattatttccttgaatctatttccaaattaatatttttttttttggtatttctacactttaaggccatttggtgcaatttagaaagtgttggcctcccttccgctagccacattcaaaattaacttccaaaacctcaggaacagtacaaagaattgaaaccctcaatatggcagcacagccggctgtagtgtatatttagggtacaccaaatcaggtattcctggtggtcttgtgcactttaatttctgttacaatgagttaagaggatgaggaagaaatctacttattaacacttactgcagaaatgtctgcattattccgtttgttttcttattattttacctctccaaacatcttcctgtgcagatcactacttcatagttgccaaattttaaaacacttaactgctgaaattcagtgtcagcaaagtgatattacgttgttctgtttctaattaaccttagcaaatgtacataatgtcaaaacccaatagtatttgacagtacttatgtatacaatgtttgataagcatttttaataagatttgtatttttaaatttagtatataataaaaagatgtgtttcagtgtg

SEQ ID NO: 1498 - DNA, 719 bp, Homo sapiens
tgaatctgacagaaaccagaaatgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtgtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaacagccatcagatgagtgaatagatttgaatgatttttcccacagggaatcagcctcaaatgttcatgtttcaccccgtcccctttaaataaaaagaatctctgtgtt

SEQ ID NO: 1499 - DNA, 1193 bp, Homo sapiens
aactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggcaggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggatcgctgggccctaggctcttgcttctggggctattggagggtcagtgtctgtgactgaataaagttccattttgtggt

SEQ ID NO: 1500 - DNA, 666 bp, Homo sapiens
tgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagttg

SEQ ID NO: 1501 - DNA, 515 bp, Homo sapiens
ggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggac

SEQ ID NO: 1502 - DNA, 411 bp, Homo sapiens
ctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagat

SEQ ID NO: 1503 - DNA, 392 bp, Homo sapiens
agaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattg

SEQ ID NO: 1504 - DNA, 893 bp, Homo sapiens
agttgacccgcaagaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaacctcttgcttaaaatgcgttttattttgataagatacttcaaatagcctccaaaagtgtagatccaatcacttaaataaacctgtatgtatatgcatatgtgtacatgcatatcccctcctgctaaaactc

(The sequence listing continues in the following parts.)

What is claimed is:

1. A computer-implemented method for determining progression of chronic myeloid leukemia (CML) in a CML patient, comprising:
   (a) classifying, on a computer, a marker profile comprising measurements of a plurality of gene products in a cell sample taken from said patient as a chronic phase (CP-CML) profile or as an advanced phase (ADV-CML) profile, wherein said gene products are respectively products of at least 5 of the genes listed in Table 1a;
   (b) determining said patient as in a chronic phase if said marker profile is classified as a CP-CML profile, or determining said patient as in an advanced phase if said marker profile is classified as an ADV-CML profile; and
   (c) outputting to a user, a user interface device, a monitor, a computer readable storage medium, a local computer, or a computer that is part of a network; or displaying; the determination resulting from step (b).

2. The method of claim 1, wherein said plurality of gene products further comprises a gene from Table 1b.

3. The method of claim 1, further comprising obtaining said marker profile by a method comprising measuring said plurality of gene products in a cell sample taken from said patient.

4. The method of claim 3, wherein said cell sample is a sample selected from the group consisting of bone marrow sample and peripheral blood sample.

5. The method of claim 1, wherein said classifying is carried out using a progression classifier, wherein said progression classifier receives an input comprising said marker profile and provides an output comprising data indicating whether said marker profile is a CP-CML profile or an ADV-CML profile.

6. The method of claim 5, wherein said step of classifying is carried out by a method comprising (i) comparing said marker profile with a CP-CML template profile and/or a ADV-CML said template profile, wherein said CP-CML template profile and/or said ADV-CML template profile is obtained from a training population comprising CML patients of the CP-CML and ADV-CML stage, respectively; and (ii) classifying said marker profile as a CP-CML profile if said marker profile has a high similarity to said CP-CML template profile and/or has a low similarity to said ADV-CML template profile, or classifying said marker profile as a ADV-CML profile if said marker profile has a high similarity to said ADV-CML template profile and/or has a low similarity to said CP-CML template profile, wherein a high similarity corresponds to a degree of similarity above a predetermined threshold, and wherein a low similarity corresponds to a degree of similarity no greater than said predetermined threshold.

7. The method of claim 6, wherein said step of classifying is carried out by a method comprising (i) comparing said marker profile with said CP-CML template profile or said ADV-CML template profile; and (ii) classifying said marker profile as a CP-CML profile if said marker profile has a high similarity to said CP-CML template profile or has a low similarity to said ADV-CML template profile, or classifying said marker profile as a ADV-CML profile if said marker profile has a high similarity to said ADV-CML template profile or has a low similarity to said CP-CML template profile, wherein a high similarity corresponds to a degree of similarity above a predetermined threshold, and wherein a low similarity corresponds to a degree of similarity no greater than said predetermined threshold.

8. The method of claim 6, wherein said step of classifying is carried out by a method comprising (i) comparing said marker profile with said CP-CML template profile and said ADV-CML template profile; and (ii) classifying said marker profile as a CP-CML profile if said marker profile has a higher similarity to said CP-CML template profile than to said ADV-CML template profile, or classifying said marker profile as a ADV-CML profile if said marker profile has a higher similarity to said ADV-CML template profile than to said CP-CML template profile.

9. The method of claim 5, wherein said progression classifier is an artificial neural network (ANN) or a support vector machine (SVM).

10. The method of claim 1, wherein said gene products are products of at least 10 of the genes listed in Table 1a.

11. The method of claim 1, wherein said gene products further comprise products of at least 5 of the genes listed in Table 3.

12. The method of claim 11, wherein said gene products further comprise products of at least 5 up-regulated genes markers listed in Table 3, or are products of at least 5 down-regulated genes markers listed in Table 3.

13. The method of claim 1, wherein each of said gene products is a gene transcript.

14. The method of claim 13, wherein measurement of each said gene transcript is obtained by a method comprising contacting a positionally-addressable microarray with nucleic acids from said cell sample or nucleic acids derived therefrom under hybridization conditions, and detecting the amount of hybridization that occurs, said microarray comprising one or more polynucleotide probes complementary to a hybridizable sequence of each said gene transcript.

15. The method of claim 13, wherein measurement of each said gene transcript is obtained by quantitative reverse transcriptase PCR (qRT-PCR).

16. The method of claim 1, wherein each of said plurality of gene products is a protein.

* * * * *